United States Patent 12,059,441 (PROBIOTIC BACTERIAL STRAINS THAT PRODUCE SHORT CHAIN FATTY ACIDS AND COMPOSITIONS COMPRISING SAME) - sequence listing, part 10

SEQ ID NO: 27 - DNA, 4816723 bp, Clostridium innocuum (residues 3,211,151-4,816,723 of 4,816,723)
  misc_feature (1042055)..(1042056): ">" designating noncontiguous sequence of whole genome
  misc_feature (3634293)..(3634294): ">" designating noncontiguous sequence of whole genome
  misc_feature (3651733)..(3651734): ">" designating noncontiguous sequence of whole genome
agaagctgtattcactctgttagcacacacaaaagtaaaaaagaaccgtaagctgtatctgtattcctgagtatatgacaggaatccgcacacttctcggttctttttttctatactgtatctatactctctgtatagcatcaaaaataggttttccaaacccggacatgccctgccggacaagcacaaggcagcttgtgcaaacatcatccgccaccgctgttctttcatacatcagcttgttcagcattgcaatccgtctataaagcatctgacaacaaacatttccgcggattacgaagcaaccgcaaaggaggaagtattatgaatacggaaaaacaaagagcctttatcatccattttgtttacagctgcctcatactggcactgctgtatctgtttctacgctatgtgatgtatgcgatcatgccctttctgattggttttctgattgccttcatgctgcgtccgctcatcaaaaggctgacagcgctgagcggcggtcatgaaaagctttggtcatcaattgtgattctggtcttttatgcgaccatcggtgcctttgtgacactgctatttatgaagggctttgcattcctgaaggattttgtggaagacataccaagactgtatcagcaaaatctggagccgtttctcaacgatacgctgggaaatgtggaaagtgtatggaaggaggtggatatcacaggtgcgcaggccatccagtcctttctggacggcctgcaggcttctttatacagtatcatatcctccctgtccaagcatctggtatccctgttcaccggctttgcgtcctcccttcccaatctgcttatcgccttcttcttcgccatcatatcctcctttttctttaatgccgattatccgcgcatcatagccttttttattcggcagcttccggagaagggagcacagatcgtctttacctcccggcactatttcaccgatacgattgcacgcttcgccgtcgcctatggcaaaatcatgctgcttacctttttcgagctgaccatcggactgcatatactggggattgaaaacgcactcgtcattgcctttctgattgctatttttgatgtactgcctgtgcttggaaccggtggcatcatgcttccctggattctaatcagttttttgaacaatcaggtgaaaacaggtgtgggtctgctcattctgtatcttgtcatcaccgtgatacgcaatatcattgaaccgaaaatcgttggaaaacagatcggtctgcatcctctgctgatgcttatgtgcatgtacctgggggcaaggctgttcggctttcttggtatcttcatacttccgattctcatattgattgtacagaatttaaacgataccggcatcatccatatttataattcgtaactgtactacgtatattcatgtatacgtaaaaggcgtcatccctggaacatcctgcgatgttcttttttattgctttttcggctgtctctaatgaaatcataaataccagcaggtgtgtaaatgcgggaaccggatgctacgttccgcactatagcttgcttccactttattgtatttttatcggatacaagtaggatacatgcatttgctaccttatatacggaagaaaaaaacaaggagggtcgtgatatttacacgaaaaagagcaagcacgtatgcagacgtttcctttggaaattatctggtaaacaaaagaggatagcgctacacaaaaggattgctgtcaagctgcttgtgattatcgcttctctgtatgcatactttcgtaggtaagcaattgcggtatacagctatatgcccctgtctgcttctgcaggcagaaaaaagagcctgctcagctattgccactgaccagactcacctgcacgtatatgattttaaatgtcatcagaagaaagactactctttcctctgctgcatgtatggcgaacagtctctacatatgcataaggtttacaagtatgcaactgcctcttccaatcagctgcatggcattgcccgcctacagtgactgtgcatgctcctattcaacaactgccggatttgtctttgtttacagcttttcaaacaatgccgtaggtgcaccgcataacggacatacatagtcctgtggaagcggatctccttcatagatgtaaccgcagattgtacatctccagccgcttttctcactcttttcctgatagctcggtgcattcttcggggtagctccgtttttcacctgatgatagtaagcataggtcataacctcttcctcactgagcacctctgcctcttccacttccccaacaaacatgacatgcgtacccaaatcaagtgtttttacaaccttgagactgtagcgtgccgccatgtgctcactgggatagggaaccccatgtgtatctcttcggtaagtgcactgcgcgaatttgtcattgtccctgctggaacaaaagccgaaatttttaatgatatccataccgcagttctgcgtcagcacgactgcactgaagcgtcctgatttttcaatcagctgctccgtataattgtccttgttcagggttaccgcaagctgtgcaggagatgaggttacctgatgcagggtatttgcaacgcagcctgcatcctttccctctgaagtagttgaaatgatgtataagccgtagctcaatttaaaaaatgctgtttgatccatattgcttcctcctttaatattaagaaccgttcttatttatacatatagtatgcgcctttttcagacatttgtaaagagaattgcccagtcttcatttaagcttttttaagaagttctccgtatgcgcaaacagggtttcatgtcataatacatatgagcaggattcgactaatttatacaaatttctataaatttttcaaactttcttcctgtaatatgcgtctaataactgaaacagcaagataggagacacggtacatgaaacagcgactgcatccggacgatctggaattctatttaaaatcgaatgaaaaacgcctgtatcgtctggcatattcttatatgcatagcgatgcggatgccaaggatatgctgcagaatgcaatcctaaaggcatttaccggtctgaccagattgaaaaacatggagtatatggatacctggttctacagaattctcatcaatacctgtctggatcaaatccgtaagcagcgtcgggaatcggtatatccgctggaggaagacatcatgctgcaggagcataccgacatgctgctcagtgaggagcttcatcagctgctgtttgcattggatccgaaaaccagaaccattctcatcctccgctttttcgaagaccgcaagctggatgaaatttcggatatcctgtcaatgcctttaagtaccgtaaagacacggctttataaaggattgaaggacatgcgtatacagatggaggaacaggatgtatgaaaaaggtagataagctacgacaggaatatgaggaaatacagacaccgcaggatttggacagctttatggatacctgcatcgatcaggcacagaaaaagcagagccgctttaccttttacaggctatggaagcctgcgctcagtgctgcccttataggttatctgattgtgctgaacaccgtaccggcgtttgcccaaagcgtattcgcgattcctctgctgggcgatgtctcccgtattctgtgcgtgcgggaatatcagaaaaccagtgatgtggattccttaagcgtcaaggttccggaggtgaaaaacacgggaaatccagagatggaggagcgtgtgaataaacagattgaggagcgcatcaataaaaccaccgagcagctgtataaggacagtgcacaggttcgggaaatgatgaaaaaggaaaaggtggaatcgctgaccgcaaaaacagaggtcacaatcgattataaaatcacctgtaatcaaaagaacctgttatccttccagattatgacaaactatcagctgaatacctccatgcaggaatatcagaccttcaatctggatttatccagtggaagagacatcacactgcaggatttgtttggcaaggattatgaggatattattaacaccagtgtccgcagacaaatcaaagagcgtacagagcagaatgaaaatgcaagctattttgacggagcgatgggatttcagggaatccgtaaaaatcagccatactatattgacagcaagggaaacgttgtcatcatctttgaaaaatattccattgcccccgggtatatgggaacacaggaatttaaaataccttgcagtgagcttcacaagtatacaggaggaaagtaatgatgaaacaggaatacaaacggaacagacatgtcaacccaaagcggcttatgctgctgatactgataccggttctgctgctggcaggcggcttcgggatttataaaatcatggctgaggatgcgtatgcggcctacaacacctatgacgaaagcaataagaaggaaggtacgatggagcatttcaccgaggagaaggaggatacctattatctttccttctattatccgaagtttgaagataaacagctcaatgaaatcgtacaaacctatcgcagtacaagtatacagacaaagcgcaagcatgaaggcatgcagtatatcgcgattgattatgccagtgaaaagctgtttgatcagtatgtgaatctaacctttatacagaagatttatgatgctgatgaaaaacaggtggatgaagtcagaaatcactatacctatgataccaaacagagaaagctaatcaccgtgcaggatgccctgcgtcgggattatgtgcaggtggtaaaaaagctggcagagacagcaggcataaaaacccccagcatcacttccctgcaggtgcaggttgaaaaagacgggcttatgctctataccggcaaggaaacaaaagggatggcctttccctataaggaatataagaaatacatccgccttgcgaaccgaaacattccttcactatatcaaaaagacgcgatcattccgacagagcagaaggtggatcccaacaagaaaatgattgccttcacctttgacgacggtccgcattggcaaaatacacaaatcatcatgaaggaatttgaaaaatacaacggacgtgccaccttctttatgctgggacagaatgtgaaggacgacacgaccggtgtggatcacacggatatcgttcgcgatatgtataaacgcggctttgaggtgggaaatcattcctgggaccactccatgcggatcgccgcaagcaaaagtgatgcgatgagcaaagctgaagtaagtgatgaaatctataacacgcaggacgccatatttgcggcatgcggtgcggatgcgacgatgtttcgtccaccctatggtgcattgaataacaatgtacgtgccgtatccactctggatttcgcactctgggatttggatactctggattggagcaataaaaacgcagatatcatcacccagaatatcatgcagaatgtgcatgacggctccgttatcctactgcatgatatccacgatttttccagagatgccatcctgcaggtgctgccgaagctggaggcaaagggctatcagttcgtttccctttccactcttcgcaaatataaaaacgaagagctggtaaatgaaaatatcgtcatccctgcctccatgaagtaacatcatatcaattcgctattttcaattcagtgtattgccataccgctgcaggtatggcttttttgtacagcctgtaatgcaatccaatgtatgaaagaccgtttgtaatgcctatgcaattggaatccatatgacagcaatacgcaaccttccatatgaaatacacagtggtattcattgctacaggatccatttcgccaacagacctcattatttcccatatcttacagagttatgaaatttatgatttttcaaccactacaaggtaatttatgtaaaaggatgctataatattaccggatagctattttggagggattatgaatacgagaagaaaaaaaataaggaaggatcgactggcaattttactggtactctgtgccgtggtgataaccacaatcggcttcggaatatggaaaatcagcggcatgctgtttcatgatccgtacgaaacatacaaagcctatgaaacaaaaggaaaagattacggagatatacagcaggtcagtaaggaatatgagaacgaggcgtttgtatcctttacctatcctgcatatgaagaaaaggaattaaacagccttgtcaaggcatacgagaaaaagactgtgccagcggccggtaagacaaagaagcagattacaagcattgattatgacagctcactgctttttgaccgctatgtgaatctggcattccacagacacacatacaatgttgatggtgtgcaaacgcatacagagaccacatggatgctgtatgataaaaagcagaagaagcagctggtgctggaggatgtattgcgccgtgagtatcctgctttggtgaaaaggctggccggggaacagggctggaaaaaggatataaagcgtgatactagtgccctttccatgacaaagacaagcctgcgtatccatctggatgaaaagcataccgtttccattccatataaggaatataggaaatacataagactgaaggattcccatataccgtcattgtaccagaaggatacagcggttgccagggcacagccaaaggttgaccctaaaaagaagatgatcgcctttacctttgatgacgggccaagtgcctatacctcggaggtcatggatatatttgaacaatacgacggacgcgccaccttcttcatgcttggacaaaacgtggaggcaaaccgtgatacagtaaaggaaatgtataaccgcggctttgagctggggaatcattcctgggatcattccatggatcttgcggcttccaaaaaaggatacatgtctgtttcacaggtcacggaaaacatttataaggttcaggatgcaatctatgccatctgcggtgcagagccgcaatatttccgtccgccatatggtgcggtaaacaacaatatgctgaagggcaatcatcttggctatgcgttctgggatatcgacacaagagactggtccagcaagaatgccgccagcatcactgctgcagcattgaacggggcaaagaacggcaatatcgttattttgtttcatgatatatatgagccaagcgtggaaagtctgaaatccatcctgccggaattaaagaagcagggctatcagtttgtcacctattccactttaatgaaatatgaaaaggactacctgttgaagctggatgccggctacggcgtatcggaagcatacgcaaacggtcattagatctgcgcattattcgcaggtcttttttcttcatttgtgctatactgaagaaaaaggaaaaggaggaaaagcatatgcttactgaaatatggacaaggcagagtatacgccgctatgaagatcggacagtagaaaaggaaaagctggaggagctacttcgcgccgccatgcatgcgcctacggcaaggaatacacaaagctggcgatttatggtgattcgcaatcggaaagctctggatgagatgacaaccctgcagccttatacaggaatgatgaaaacagcgccctgcgccattcttgtgatgggtgatcaaaaagctaccgatttggatgaatatctgtactgtgactgcagtgccgcaatccaaaacatcctgatagaagcacggcatcagggactgtcaacctgctggtgtgccgtgggaccgcgaaaggagcgcataaataactttcgcaattattataagttgaaggaggatttactcccggttgcggtcattgctgtgggctacggttgtgaagataaagaaattgcggatcgctttgacccagataagatttcatacttcgactgatggatgaaggatacttcgtttctcgtaaatgaaaatacgcaaaggtatcgctgttataggaaacctttgcgttttcaattttaaaaatcacaatgctgcaacaggcctgaaaatgtctgttcattaccagatccatttgcttcagctaccatgcctgctgttttcagtatcaccgctgatgtaagggaagtatttctgcctgtcatagcatgtaatctccagttcaataccttcactgtccttcagaaaaaatgcataatagtcctcacagtattccggataaaatcttggcgcatgaacaatctgcatcttcatctgcaggacctgctcgtataagcgatccactgtttgcgtatcatctaccataaatgccacatgatgcaaagctccaggcttcctgcggctgagcttttccttttcaaaacagctccgcggactgacaataccgatggagaacgccgcatgatggtattctattatttcatatgcatttgcttccttacggtcatattccttataacgcagatcaaagccaagcagtggcagaaattgatcataaaagcgttctgcacgttttaaatcacgaacggtgacatgcagatgatcaagtaaaggagtcatatcaatcaccgctatattgcttcaaccatgcttcatcggcaggaaaacagcgatgaactccgttttcatatgccgcgaccatgagggttacctcaccatcctgtgccacaacataaggaaattcctttaaatttgtcacagcagcacagttcccctttgtatccatggcaatcatggatatggcatcacagtcgtttccagcctgcttcatacgtgccatatgggtatccagcacctgaatcaaagcatcctgtacggctatccctgcacgcatcagatcaacaacccgaacagacagacagccacgcataatatcttctcctagaccggttgccgctgcactgccggccattgcgtcactgtaaaagccggagccgatgaccgggctgtcccccactctgccggcatgctttaaaaacaacccggaggtagacacacccgcagccatttcattatcctttgcggccagcacgcaaaccgtgtcatgaccgtcatatgcctttaaatccgcatccttcttagcctgtttccaacgctgcttcgaagcctcggtaagattatttgcaaaagcgaagccttcctcctgtgcatagccttccgctccctttccggcaagcagacaattgcaatgcttcccgcacagggatgctgcgacctcgattgcggatgccacattctccatctcaatcacaccgccaaaatttaatgttttcccatccatataggctgcatccagctgcacatgcccgtcgatattgggaagaccgccctttccgaccgacacaaattcctcgcgctgttccacatcctgtatcgctgtgcgtatggcttcctttacactctgctcccgcaaaaccgctgctcccctgcggataccgtcaaatgccatcttccaggttcctatcatcgtctgcttcattgttcattcctccgttttcatctgatgtatgctcactctgtttttccatgtttattatacaggaaaaacgcgcagggatgaagcataattcacacgctcgcataccgtaagctcttagatccttccataaattattttgaacctcatactgctgtacctccaaatgaccggtataaaaaaagaaagccggcaaattcccgggttctttcttacgttagggtatttgcaaaagggagacttcagcttctattgataaaaacaataatatgtaagtctccctatgttaagtttacccacaatcaagaaagaaccaatccctgtaagcagggacgcctgactttccattttctgcacactggactggcaatgcgctgtttgttttctatagcagcggatcaactgcatccgtgttgatatcacgaatcgtttcacagctctggttaaacttcgcctgatccacttcattcagatccagctttacgatttcacggatcccctgacggttgacaactgccggtacaccgatatacagcccctcttgaccatattcgttattctgatacgcagacactgtcagaataacattctcatcatccagaatggcatgcaccagccggttcagcgacagtccgattccataataggtggaacgcttgcgcttcacgatttcataccctgcctgctgtacatttgtgtagatgtcatgcagatcggataaatctctgcccttttcatccagcaggtccagcagattcttgcagccgacataggcattggtccatggcacaaagctggaatcgccatgctcgcccatgatatacgcgtgaatattgctggtggaaacatccagatattcgctcatcatatagcgtagacgggctgtgtccagaatcgttccggagccgatgacacgctccgtcggcagtccgctcaccttttgcgcaacataggtcatggcatccaccggattgctggcaatgaccaggataccgtcaaagccgcttgccataatctgctcggttacgcttttcataatcaccgtgtctctcgctgtaagatccagacgtgtttccgtcggcttctgcgtaacaccggctgttatcacaacgactgccgcatcccgacattcctcatagccacctgccttgatactcatcttacctcttgcgtagggcaacccatgctgcaaatccatcgcctctccgatcgccttttcctgatccacatcgatcagcaccagctcgtcgatccctccggtattcaaaaagctgtacgccatgctcataccgacaaagccacagccaaccagtacgatttttcttttctcattcataaagaaactacctccagatattccaatcattctttactttaccataaaaaagaagataagaaaacagcaatcatttccttatctcctgtagaaaactgtccgaatcaaagcagcggatcaatgatatcccggttgatttctttcaaggtcctgcagctgctgtcaaatttagcctggtcaacctcattcagcttcaggcggatcacctcacggataccctctctgttcacaactgcaggtacgccgatatacaggcccttctgttgatattccccttcctgataagcggaaacggtcagaatggcattttcatcgtccagaacagcatgcaccagacggtttaaggaaagcccgataccatagaaagtcgccttcttgcgattgataatttcatatgccgcctgctgcacattggtatagatgtcatgcaggtcggacagcggctttcctttttcatccagcagctccagcagtgatttgcttccgacataggcatgtgtccacggaacaaagctggaatcgccatgctctcccatgatataggcatgcatgttggagctggatacatccagatactcactcatcatataacgaaggcgtgccgtatccagaatcgttccggagccgatgacacgctcttttggcagaccgctgaccttctgtgcgaggtatgtcatgccatccaccggattgctggcaatgatcagtataccatcaaagccgcttgccatgatgctttccacaacactcttcataatttttgcgttcttcgctgtcaggtccagacgtgtttcctccggcttctgggcagctcctgctgtaatcaccacaatactcgcatctctgcaatccgcataatctcctgcatagatttccattttacctctggcatacggcaagccgtgctgcagatccatcgcctctccgactgccttttcctttgcgacatcaagcagcaccaattcgtcaattcctccggtgctcagaaaactatatgccatgctcataccgacaaagccggtaccaaccagtacgatttttcttttttcactcattgtgaagcctcctttgcatgggttttcactatatgttacccatatctaaccaaaatataccacgcacttgaaaaaagtgaaagaaagatgaccgaaaagctgtacgacagtaaccatgacgaacaaaaaccggtatatgaaaagaccgtatggaatttccaatgggtttgcagagaatttcaattaaaggagaaatccatacgatagtagcttatcatcagaatctgaatccttccttttgcatacaccctaaggtaagaatagaacctttcctcaggcataatcagtagacaatttatatttgaaccatacatttgttcgtatcgccttcctttgattacaaaaaaaagatcagaagctgcatacagactgcaggcatccaatccttcttgtgaccgcatagattatgcggtcatacttagcgaatcatctgttttattttctcaacatcctcttcactgccctcaccatcgaccttgtaaagacagggaacattgtatttttctgagatgatatcccccgcccagccaaaggttgcggcatggcgctctctgcttcctccggctacaaccccctttaagccgtcagggttgttttccaggaagctctccacgatgtttggaacgacaccattcccatccgtataagtaaatagaatgtaatcacccttcaccgtttctgtaccgttttctattttcattgcgtcaatcgcaagcttttcgatcaatttctctgttttacccattctggatgcatatacatatgtcatactgtgacctccttgtttatctgcataaatattaccataggctaacaatcaaagcaactctcatgccccgcattgtatatgcttgaatatgagagcaggtgtatgcatcgcttttcaggattacagctagttgcttgtgcagaccttttgcatatatcatgcctgcaatttcaaaccgctttatagctgcttacttttcttctctgtcttcctgcaattcatacctgtactttacattgcctgtacaattacggtatccgtatgaaaccgcagtacgatgaagtatgcttttccattagaaaaaaggattccatacgattacatccgcatcctatgaaatcctttgcatgatgtattaaaaaacaaaggatagtagaaacatggtttttatagctgcctacagatcatccaccagcgcactgctcttcgcataagcggaggagcgtgcttcaaaaaaatcggttttgatcagattggcattcgcatacatggatacccattccatggatttcggttcattttcaaagccgtcgtacaaggaaccgaagccaagagaattgctgcgaagatttcccaagtaatgaatgtaatcggataccatttccattgtcagtccttcgatatgatttcctatcacatactctccccagcgaatctcctcctccacaccatggcgaagcatgtccttatattcctcaatcagctcttccgtaaacagctgcggctcctctttttgcagctccagaatcatagagcgaaacaaccatagatgcgtattttcatcccggttgatatagcggatttcctgtacggagcccggcatttttcccatgcgtcccagattatagaaaaacataaagccggaataaaagtaaataccctccagtatataattcgccatcatcgttttcatcaaatgtctgccgtctctatgtgtctggaaatcattatacagatccccgatgaatttgtttcgattcaataaacgctcatcgtccttccactggtacagaatatccgtgcgttcctgcggtgaacagatggaatccagcatatagctgtagctctgagagtgaacagcctcctgaaaggcctgtatcgtcagacacagattcacctcattggcggttatatattcccctacatttggcagattcgctgtctgaatggaatccagaaaaatcagaaaggacagggttttgtcatatgccgttttctctgcctcacgcagcctgcggtagtcctttacatcctgattcaggttgatttcctcaggaatccagaaattgttcatcgcctgacgataccagtcggatacccaggtatatttcatgttgttaaaatcattcagattggtcgtattgccattgatcatgcggcgctttccgacctcgcaatccccgtgttcattaaacagaggctttcttactaaatcactcatacatactcccttctaggatgcgcaggattcgcattcctctacttccaatgacttgctgcgaacataataaatcgtttttacaccatattcccatgcgtgaatatacagcatcagaacctggcgcagggtaaattcattggtaatatacagattgacagactgtgcctggtcaatatgacgctgccggataccggccgagcgcaccacccattcctgatcgatcagatgggcattcttatacagccagaaggttctcgcatccaaatccggtgcaacacgggcaatcatactgccctttttttcttccagaaaatatttattcataatcggatccacaccggccgttgttcctgcgatgatggaggtggagcttgtcggtgcgattgccatcagccatgcattgcgcattccctgctcacgcacctgccgaaacagccggctccatgcatcggatgtatagcctcgctttgtgaaataggcaccgctttgccagtcacttcctgcaaacatggaatagctgcccttttccctagccagtgcagtgcttgcctgaatcgcatagtaattgattttttcaaaaagggtatccgcaaattgcagatgctcctcggactcaaaccgcagattctgcttaaccagcatatgatgatagccgctgactcccaaaccgattgggcgatatttgcggtttgtgattttcgcatagggaatcggataataattcagatcgattacattatccaatgcgcgtacaataacatgaatgatatgggaaagctcttcctcgttgtttacatcaatattccccagcgacagacttgccagattgcagacgacaaaatctcccggcttactttcattaactaccacgctctctccgtcaatttccacaatgcggctttcttccagctttagcgccttcatattctgtgcgatttctgtacagagattgctgcagtaaatcataccggcatgtgcatttggattcatacggttcacatgatcacggttaaaggtaaacggtgtaccggtttccactgccgatttcagaatcagacgtaccagatccttcagcaccatggtgcgcttgggaacacgcgggtcctgcacacagtcaaagtagcgctcttcccattcctcaccatagaaatcctccaggtgatagcccttgattttatgaatttcatgcggacacatcagataccaggtcgcattcaaatcctcttttgccatcttccagaacaggtccggataacagacagcaggaaacacatcatgtgccttcatgcggtcatccccgttattggttctcagattcaaaaactcgggaagatccttgtgccaggcatccagatagacagcgactgccccctgacgaacccccagctgatcgactgcggtcgccgtatcattgacaagcttgatccagcgtatcacacccccggcagctccctcaaagccgcggatatcactgccgtttgcacgaaccttgccaaaatacagtcccattccaccgccgtatttggaaacctgtgcgaaattatccacactcttataaatattgtttaaggtatcctctaccgtatcaatgaagcagctggaaagctgatgatacggcttgcgggcattggacatggtcggtgttgccatcgttacctgcaattgagagagaatatcatagatctgcttcgcccagtacatgcgattctgttccggcagtgccagatgcatagcgatacccatgaacatttcctgcggtgtttccaaaacctcatgagcatgggaacacatcagataccgttttttcacgagctccagaccgctgtaggtaaacaggtaatcgcgctcatccttcagatatgcgcccagctcatcaatctccgcatcactgtatgccttccgtatataatcaccgtaatatccctgttcttccagatatttcagttttttactgaatacgggaagctccagcttttgcatgcgggcactgatttcctcatgcagtgcataggaaagaaagcgggaagcgatatattcccatttgggtgcctctttactgattaactcaacacttgccttcatcagcatatgcagccgctcatcactttccatatcctctttcaaaaaggaatgaaatttcatgagcagatgacgcagatcatagccctcatccggataacgctgctgaatatccgccagtatgctgtaaaggtcttccttttgcagtgcatggacaaggtcctgtaccaccttcctggattccgttcgcttctgacgatacaaaatatagttttttgcttctttataaaactgatgctgcatcagttcttcttctacaagatcctgaacgacctctacactcagcatcggcttgtctgccgctgctgcttttgttatgtcctcaataatttccttaagtaccgactcttcgatgagcgtcccggtactgctgaatgcttttctgattgcctgtgcaatcttctctccttcaaattcctgaagttgtccatctcttttctgtatcttcatatacataccacctatcttgtattagtataggtggattgtgacagttcacgcaacttaaatgcctaagaaaaaactgccagttcctgacagtattcctgaatatagcagctcatattccgtttgcttcataaaacatcaattctttattaaaaaattcatcaccagtgctatcatgatttccttttcttccggcttagattcagcaaccatcagtgtgatggcaaccagtgcactatcactgataattttttcaccattatgaagcaaggcattattcttatttaaaaattccagaaacaatgctgctgctattcgtttgcatccatcagcgaacggatggtccttaataagaaagtataaaaggtttgccgccttttcttcaagtgttggataaacctcctggctgaatacatcctgatatacagccgccaatataccggcaacttttccaggctctttttccactccgaacacatccgaatcaaagctcattttgtcaatgaattctctgctttcttcataagtcaactgataaacacatttggttccatccggttttttcaagctctggtgatcataactgtcaagcaattccaaggctgcagtgtattcttcaaccacctgaagaaccgagtctgcatcaataccggcgattccggcaataatgccggattgcagtcgtattgttttatttaaatattgcagccttttctcattaactgcatagccttgaaccatgtaatcttttaggattccatttgcccattttctaaattcaataccgcgttgtgatttgactctatatcctactgatatgatgacatcaagattatagttgtccacttgatacgtttttccgtcagcggcagttgtcgcatattttgcgacaactgcttctttgtccaactctttctctttaaatatgttattgatatgtctaccaatcgttttgatatccctgtcaaacaacatggaaatctgcattctgtttagccaaaccgtgttttcttcgggacatactgatacatccaactgtaattctccatctttgaataccactacatttaaatcacgattcttaaagttctctaccattttttcacctgatgctatcttgtcagcatctacctttctataatattcttttcatctggaacagcgacagcagacagcaatctgatttcgtgtactgccttataattttcttgaaacagcatggcattatttttctttttatattttggacacaaggcagtgggtagtcgctttcatattcagaaagaacctccttgataagcagagaacaaaatttatccctttcctatcatgtatcaacttgattatttttacagcgtgatatgaagtgaaatgtacaaaaccttaaactatgaagctcacatattttccaattatacttatattacagatcagcctgcgaataaactcatgtcaaggttatagtgtgtcaaggctctttgaatatttctttatcctactttacgaactaccgggtaattctcggtagtttctaattttataaattttaacacggtcctctttttactttaaaatgaatcgtatagcttatatcctctcttaagatgtattttgtaattgtaattcattctactcaacaaatagccctctgcatgtccttcagcggtgatataacgttccatacgcaatatgaaaaagagatttcagaaatgacggtattcggcattcaagaaatctctctatctatcacttttacataaaataagaagagatacacaattgctgctttcctattttttcatcaactggttgattttcatctcatacggagttcccttaagatcctttgacgccgcctgcagatgttccttctttttcttttcatccttcaaatagctgtactgcagcgccagcatataatggaacatacccttctgcgcttcctgcagctcttcattcttcagctgtttctccatatcatcgatatagctggtcttttcttccagcagaatatcatagatgacctgacactcctgagtaatgctctcatccgcaatctttttcatacgctccagcaatgttttacatttctttttgctatcctcgtccagatagtaataaaatgcttttatgacaacatccagctcctgctttttattcatccgcatgctcagaatcaattcaaagcactcttcgatttttttcttatccgctttcatgatatagccgtttaaacgcatatattcacggttgaacggaggatagaaatacttgcagggaagagaatccagaagcttgaaatacgcattgaaatcaccctgctgcatatgctttaacagcttcttcaaaatactctgcttccatacctgcgtgccgacaatcagtacgattgtaataacgacggccaatataataattttatagtccatagtacacctcagttttcattaagattattgtactatatcttgtcgcctttttcacttaaaattttcattttctgcataaaaattaaaattcctatacagcgatgtcttttttgattgcggctgaaagccttgacagcagatactgcattcatggcagagcatatagtcattcgtatgataaaagcattttgtataagctcatgtaaagttacgaaggcgaagcgcattgctgacaacgctcactgagctgaacgccatcgcagcacctgcgaataccggagacagcagcggtccgccaaacagatgcagcacaccggccgcaatcgggatacccagcgtattgtagaagaatgcccagaacagattctgcttgatattgcgtataactgccttagataaacggattgccgtctccacatcctgaatattatccttcaccaatacgatgtcagcactctccaccgcaacatcactgccgcttccgatggcaatgccgacctcgctttgtgtcagagcgactgcatcgttgatgccgtccccgaccatggcaacgactttcccctgtgcctgcagctttttgacctcctcccccttttgatctggaagtacctgtgctatcacatgttcgattcctgcggcttccgcaatcgctgccgctgtgatttcattatcgcctgtcagcatgaccacatcgatttgctgttgacgaagacgtcgtatgacatctttcgtctgcggcttcagctgatctgcaatggcaataatcccatatatatgagaagacgtgccgatccatacgactgtttttccctgctgcagccaggccagctcctgtgcggcatatgcatcacaggaagctcctgccagctccagaaaggtgcggcttcccgcataccatgtcgtatcatcccgaataccgctgagaccgcgcccgttatgtgtttcaatatgcgttaacgcagaaccgctgatattttcttccctcgctttttccagaatagccgttgccagcgggtgacggcttcctgcctccagagatgccgcaatggaaagaagcttttgctcatccttggctgcgatatcggttacaaccggcttaccgattgtcagtgttccggttttatcaaacacaattgtatcaatactgctcgctgtttccagtgcctctccactcttcataaagataccgaactgtgccgcctttccggttcccaccatgatggcggtcggtgttgccagaccaagcgcacacgggcaggcgataaccagcacactgacaaagatcgtcagcgcaaaggcaaaatcctgtgtggaaagataccagagcagtgctgctacaaaggcaatcgccataaccgttggcacgaaatacagggaaatcttatccgcaatacgtgcaatcggcgcctttttgccctgtgcctcctcgaccatacggatgattttcgcaagtgtggtatcctcctcaaccgcattgcattccatcacgattctggcatccagtgcaatcgtcccctggatcaatgcatccccctgctgcttggaaaccggcatactttcccccgtcagcatgctttcatccacactcgcatgtccttcctttaagataccgtctaccggaatatgctctcccggctttaccacaagcagatcaccgatcgtgatttcctctgcctgaatttccacctctttcccgtctctcagcaatgtcgcattgcttggacgcagctgcagcagtgcagaaatcgcccctgtggatttcttcttcgaaatgctttccagatgctttccaaactgcaccagcgccacaacgacaccggcagattcaaaatacaggctgtgaacggcatgcagattgccctgcagaatggaaatcagagaatacagggaatacagataggcgctccctgtaccaaccgccaccagcgtatccatattgggcgccttgtggaataatgctgtaaaccctctggtaaagaaatgacgtcccagaaggagaatcactgtcgcaagaagaaattggatgagcgcaaaatgaaagggatgtgtgtcataatgaatgatatccggcagcggcagccggatattgcccagcatatgcgacataccgatatacaaaaggataaaggccagagccagggtggtataaatttttatggatgtagaatcctttttcacagcttcttcctttcgctccacatgaagcgtgccgtgatacccggtattctgaataattgccagaatctccgacagcttgattttatgcgggtctgcttccactgttgccgtatttgtgacaaggttgatgctgacagcggatattccttccgctttattcaatgcatgctccagcgctgcgctgcaggacgaacaggtcattccatccacatcgatgcgatatgtcttcttcgcttcctccagcagcgtgaagccggcctttttcactgccgctgcccacgcctcgaaattctttttcgtaaatgtaatgcgcacggtattcattaccagattcacactcgcctgctcaatttcctcaaagcggttcaatacccgctctacagctgcactgcaggcggcacaatgcatgccctcaacacgataggtctgctgcttggcagcatcgcgctccttcatatgaaagccgcccttttccacagcctgcatggccgctttttcgtcaaagccgtccgtgaagctgaccaccgcttcttccataaccagatttacggaagcatcctctaccgccggctgacgcttcaatattttttctaccgaggctgcacatgctgagcagtgcatcccttctattctatatgtcttgttcataagattttccttccttctatttcagcagtgccgcaattacagcttcgatttcgctgaccttttcctctgcatccctttcttcaatagcagtcagtacacagctgtgcaaatgtccgctcagaatatgctgatttgcttttttcagcagagccgtcgatgctgaaatctgatttgatatatcgatacaatagcgtccttcttccatcatgcgaatgataccatccagctgaccgcgtgcagtctttatcttctgaagtgcttttttacgttcatcgttcatcctctcacctcccccagggggtgccctggtacattcctattatagtagctgccttttctgctgtcaactcctatgcctttatgaattcctttgttgaagaggatggcggaataccacctgcttatgtccgcatgccgctttctgagcgtagcaatcaagcgttcctgtattcctattccaatcacgcatcctctttgagcaggcatttaacaaggatcctatctatgctatcctttcataaaatatgcattatgaaatcttacaatttcaatatatttctatactttcacatgtcctgcacacgattgtacgatataataaagacatgtgtggaggttatcgacatgattaagaaaaaactgtacatccttatgctgagccttttgatcacggcatcccttactccggtatcagccagtgaaaagacgctgcaggatgatggaacatatcacattgtcagtgtggaaaaggatggtacctatacaatccttgaggactgtgacacctatgccagggcaaaagttctctatacacttcgtaaacgcagctatgacaatctcgcaatcacctatggcagcagcttcctgagtctggagcagggcgttgtggaatttgcgacagccaaagactgcacgctgaacattacctacacaaatgatgaaaatggtgaagagggctataccaacggctgttatggcattgacgcggcatttctggaatacaatcccggaacacaaaaggtaaagtttcgtttgtccggtgttaccggatgggcagatgcagccgatgtcaccatctatccgattgagcaggttcccaatgtttcctcatttacggtaaaaaacaacactctgcagcatcagctgaaatcctcactcgcaaccgctgcctatgacaatatcctgcagctgggaaacgctccgcagcagctaaaggagggcgttacctactatagctatgatacccattatttctatgatgattacgctatgatgatcgaagattaccgaaacagcagcttttctcatgcggtgaatgccaatgccccctattataattattatcagtatctgaatcatcgatccaccagtgcctattcacaaaaggatgtggaccggtatctgaaggatacgctggctctgcgtcatacaataaccggcttttacgataaggataactatatccatgatgttttaacgcaatctttgcttttacaggcggaagctgcatttttccagtatcagaatcaattcggggcaaatgcgctgatgatgctttcactggcggagaatgaaagtgctctgggaagaagctatctcgcctacacccgcaacaatctgttcggacatgctgcctatgattccgctgttgaggaaaatgcctcccgctatgccagcacctcaggcagcgtatactcccatgccctgcattacctgtccaatgcgtatatgaatcccagccagtttcagtttcacggcggcttcttcggaaacaaggcaggcggtatgaatgtatcttacgcatccgatccctactggggagaaaaagcagcccagtacttttatgaaatggatcacgccatgggggacagggatcacaaccgctatgcgcttggtatcgtgaaaaataccggtgtttccatatataaaaacgctgataaaaaaagtgatgccgtatacagcatcaaaaaaggctatgatgcagccctgattctgctggaaaagctggagaacagggatggcgtctggtatcgggtacaaagcgacccttcccttgacaaagagcagaagcagcaggaaggaagctacaatttcaaaaacagctatggcttcgtgaaggcagaagatgtttccacagtgctcaacagcaagcacatacaggataaagcctatgtggatatcacctttgatgcgaacggcggaacattttatcccaatgataagaaaatcaccctgcaggtggaaaccggaaagacaccggtgatccaggcaccggttaaggatcatgccctcttttcttcctgggatatacagctaaagcccgcaggggaaccgttgacctacaaggcaacatacagggatgtcaagcagattgtgctgacacagatgccgcttaccacctatgatttaaatgaatccctcgatgtcagtgatggcagaatccgcgtggattttgcggatggtacaagtaaggaggtttccatgaccaccgatatggtggagggcttctccagcaaaaagacaggaaccaaaacactgaaggtgacctatgccggctgtacgctgaattatgaaatcagggtatccgacgagctgacgaaaaagcaggaaaacatgcagcagcgagctgcggcagtcattaagctgtacgacgggaaaacggatttaaacgaggaggctctgcaggagctggagcagctccgcaaggatgtcactgcattccctctcacaccgctcgcaaatgagcagatccgtcttatcgaccggatactgcaggagaatctgaagccccgctacagtgtcatcattaaggatgacagccatgatctgcaggtatccggcttatccatggcacggatacaggaaaccggtttcctcaataccttcctgccaaaaacgattgtcctcaaggtaaagaattccatagatgaggagcagcaggcacttgcaaaaaaagtagcccgggcaaacggaaccactgttgaagaaaccttctctattgaaggaacggatgatttctcctccctgaagctgaagcaggaggctgtcttctctatcaaaaagccgaaggacagcaaaaacaaacgctatcatatatattatgtggatgggcaggatgtctatcagattcccaccgagcaaagtaaaagccgcatccgctttacaacggaaaagcttggcagctatgttctggtatccgcaaaccagcgcagcatacaggaagcagacgatattgcagaggtgaatacgatcgccttgaacggaaagaactatatccttcgctatgtcctgttgccatgtctgctgctggcactgcttgtatgtctgttcctcacactctttgtataccgcagacggcatccgaatctgcgtctgaaaaagccgtggaagaaggcaggaacggaaaaatcgcagtacaaaaaagatgaagatgatatgctgtaggaaagaaaacggaagaaatcacacgcctccttgtgatttctttttttttgacatacaatactatatgaggtgatcatacatgaaacgtaacgaaatagattcacagctgacctgggatctgcgctttctctttgaaaatcaggaggcctttgaagctcagtttgcactggcacaaaaggaaatcaaattattgcaggctgcactctcatcccttgcggatgacagagccagcttcatcagctttatggagcatcaggaaacactggagcgctatctggataatcttatcagctatgctaagatgagcagtgatgtcgaccctgaaaatatgcagaaccaggaaaatctggcacgcagctataccctgtatcagcaggtgaatcaggcattatccaatctgcctttacttctgattcaaaacagggaacaaattgagcaatggctgctggaggatgactgtcgggacttccgctacccgatggaagaggtattccgtacgattccacaccggctgaatgaagaacaggaggctttgcttgcacaggcgggcgagctgatccgcaatccacaggaaacctttgaaagcttccgtttgcagttcgagcctgttctggtggatggaaaagaggaattcctgaatgaaggaacctatcagcagttcctgaaaaaccgtgacccaagagtacgtaaggaagcctttgaacattttttcaccgcctataaaacctatcagaatgtgtttatgaatctgttgagcgggcatgccaggggacagatattcgaagccggtttacgcaatttctccaatgctctggaagcctccctgtttgaagacggcgttgaccggtcgctgtttgacaaggtgcttttcatggcaaatgaaaaatacatcaatggcattcaccgttactttgcggttcgcaagcaggtcagcggacttgctgttcagcatgtgtacgatattcagataccactggtggatgcggtggatatcacctattccatcgatgaaagcttcgatattctcaagcatgcccttgcaccgcttggcgaagactatgtgcaactgctggatcaggcaagagaggagcgctggatcgactttctgccatgtgcaggtaaacagggtggagcatattccggggggacctatgattcccgcccgtatgtactgaccaatttcacaaacgattatccttccctgagcacgctggcgcatgagctgggacattccatgcactcctggtattcccgtcaccataaccggccaatgctttctcagtatacgatttttgttgccgaagtggcatccactgtgaatgagattctgttgaaccgttatctgctggatcacagcgatagtgaggaagagaaagcatatcttctttccaatctgctgaatcagcttgtcggcacgctatatcggcagccgatgtacgcagaattcgaaaagcagctgtatgccatgctggaaaacaaagaagcagtttcctcacagaagctgacctccctgtacatggagctgtccaggcagtattacggggatgctgttgaggtggatgatctgcagcgctatcattgttactacataccgcacttttatttcaatttctatgtatataaatataccttgggtatgtcggtggcattgagctttgcgaagaagatacttgccggagatacaacggagtatctggagtttctcaccaagggtggcagcgagtcaccgctggatgagctgatccatgccggtgttgacccgagagtggacagtatctacgacgatgccttcacctttttcgaaaaaacactggatgaattcagtgaactgatgaaggtaaaacgataatccctttataacagggcaactattgcagggaagccttgatgttcccctgcggctgtaccgatagcttaacaaatattatccatgtagctgaaaaagaatgcagaacctttggatggtaagcgtccgtaaggattttgcattcttttcttttactgtatcgctgttctatttctgcttgcctctgctttgctttactttctaaatatcggttcgatctgctgtttaatcaaatccatgctgtcttttgctttaggatcaaatctgcacatgagggatacaaccagttgttctccggtattcacataaataatgtttcctccatcccccattgccgcaaatccgtctttctgctcatcgatccaccataaatagccgtatggcagattgcgttttttccagcggctgtgctcctttgtgctttcctcaatccagtgctttgataccagctgttttccttcccatacaccgccattcaaatacagctgcccgatatctgccatttcctttgccgataacgccagtccccagcctgcggattgcagtccctttgcgtctgctgcccaaccgctgatggaggctgactgattgaatgccatctgttcttccttatctttaaatatcagttccttttccacagaaattcgcagcggggcaaataatttctcacgtgcaaaagcaagcacagattgtccggttgtcttttgtaaaataccagtcagaatatccggtccaatcagcggtgtataacggaatttcccgccccttcccttcagctgctccagtgaaaaccgcagccagtcatcacttgtaaaatattttatatagggtggaattctatatttatatgccgctgtcatggtgatgacatcctccagtgttacttcaccctttgcatactctttctcccgggctgcatactccggaaaaaaatccagaaccctttgcgacacatccacaatgtacccttcatccattgcgattcccagcaatatggatacaatacttttggtcacggaatacacatgcattctgctttcggaagtacatccctgaaagtatgcttcatacacggacacaccgttttttaatacattcatcccacaaatattcttgtaattcctgttgatcaatgcttccatttctgttattttcatctgttccatgcaattacctccgcagtttctgcctatatcttacagttttccctcaggggaaggtcaagggggataatgcagaaagcttcggctgcacaaatacagagctcataggctggtatttcgttagcttatcaacgaatctcgcacgttttcaagtgataaaagccttatgaagatatccttttttcaattgtgcagatctcttttagcttacgcctccttccctctctacacaaggctttagtagaaccatattctctttttgccttgctatgcaaaggaaaagatatacagcgttttccctcaactccgtttcacaagacgcagcagcttttatctgcttatgagcacagaaaagcctgtggtacacagcagtatacacgcaggccttcattcataatcaaaagcaaagaaatttacattttttcagactgtctcaatatgagaatttctcgtagtattccatatcctcaagaactgtgatatcctcgattgggttttcatccagacgaagctcatacagattcttcagtctggtcagcggtgtcacatctgttacataattcgccttcaatgtcagggagctcagatatatacattcctccagcggggataaatccattacgccattgtgatccagccgcagggagcttaaattgatcagcttcttcagcggtgaaagatctgtaatgacattgttgtataaatcaatcgtactcagattggttaaatcctttaatggcgtcagatcagaaatattgttgtgggaaagccccagacattccaaattgatcatatcctcaagagaatcaatactgcgaatatcgttgtttccgacatccagggttgtcatatgctcacagccctttaaaacctcgatatgcttgatatgattgttgaagacattcagctctaccagatcctttgcattcttcaaaaagtcgatgtccttcaggaaacagcagctggctttaaaatagcgaagcagcttcatttcttttaaaatttccgtatgctccacacggttttcactgatatccagcttctccatcctgatcagacccttcagattacgcaaatcacaaagtccgctctgcgtagcacgaagatcctttaaattcttcagcttcttcaggaatgagaaatccttaatatggtcaaaggagatatcaaggacctccagattcggaaattcctccaatatacttaaatcacgcagatattcacaatttgaaatattcagattgcgcagggaatccttcatatactgcaacggagataaatcacagaacagattggtcgatacatccaaaacctcaatgtgcttcaaataggtcagatcggcaatgtcatacagccacatcttgttcatatgaagctccttcagctcatccagcataccgagaatgctgagcgggaacggtccgttttcaattccgacatacagcttcttcagcttcttgacattttccagatataccagattatccaccttgctgcgttccagattcaattcttccagattgatcatgccggccagtgcactgatatccatcgtatacaggttattgcgtgaaatgtccagccgcagcagctgccggaattccctcagcgcctggatgtcacgcagcatattcttggacagattcaaaacttcaatctcccgcaaatcacggatcggtgtcagatcctcaatggcatttccgcaaaggtccagatacttcagattaaccgcatattgcagtccttccagagagataattccactgcttctggcagagagtgtcgtcagctcttccagctttttttctgtgatatccgtttcctcgatctgcagggttctggcgattgcagctcgcagcatttcatcctgtatgatcataaacattcctccgtttcttttcttgtatgcctatattataccccaaaagattaaaatctgaaacagcttacacaaaaaaacacgaatcatgaaaaaagagaaaaacaaatccttccaattcacgaaataatgattgactttcggttttgaaagtgatattgtttaagagtaataaaaagcaataattatgatttcacaagtctggaattgtatttatgtgtttcaatgtacgaatatccagttttgtgatttttttatacattggagggcttcttattgacacacgtataggaggtactaaaatgagtacaggtaaagtaaaatggtttaatgcagaaaaaggttatggattcatcacttctgatgaaggtaaggacatcttcgttcattactcaagcatccagagcgacggattccgtacactggaagaaggacaggctgtaaacttcgacgttgttgaaagcgatcgtggacagcaggctgctaacgtaactgtagcgtaagcaaaaccgttcttggatcatgacctcgtgcatgatccttttttttgactgtgcatatcctgtacggaaatgatacaatagaagaaaggatgtgatgtcatggatcgcttagaacttatccgtgaacaaacggatgccgtcattcaaaagcttgtcaaggaagaggaacgcaaatttgcatatatccacacgtacggtgttgcacaggctgcagccatgctggccactttgcgaaagctggatgtggagctgtgctgtattgccgccatgctgcatgatatagcactttacgcccagaattgtccgcatctgggtcatgcacagcgcagtgcggaatatgcgaagcagctgctggagaagatggaggtattcagtgaagaggaaatccggatactgacccatgttatatcggtgcattccgataaaatgaaccggcatgacggaccgatttcagagctgctgaaggatgcggatgttttgcagcattatctgtataacccgaaaattgagttatcggaaaatgacaaggtacggctgttttatctgctggaggatttgaattgtgcacaggtagaaaaatagctgtctatatctgcaagcagattacgcgtaaaaaggagtattcacaggggatgtcccttgcatactccttttccttttctaatttgccctaattgttccgtttttaagctacaattctgtattcaggatagctgcggctttcctcatactgctgctctataagctcacctcttttttttcattctttcgtcggtaacagatagagcatttctgcatgagaggaaaggagacagccatggtattccccaaaacaagcatactgatccaggtaccctcgcgcagcattgtaaaatccagggaaaacacagcaacaagcagcagactgcaggtgatgaagacagcatctgcaccgcagcgcagaaaattgaagggctttttatatttttttgaaatcacgacaatcaactgttcaaacggctgtttcacaagatcagcagccatggtaagcgtaacaccaaaggacacaaggatcatccccactgccagaaacacccattgcataggatacgatacagggcgaatatccgcaagaaacgctatatcatagcaggtgagattgatgataattccctgaatccagcacaccggtagctgtaaaacctgaagcttatcaaagtccttccgctgtatcagcagctgcaataaaacacatagcagataaaagcacataagaagtgtgccgcttttcataccactgataagtgaaatacattgcagaaaggctgtcaatgcagtttgtccaagaccggatttcatcatgaatgaaagtcccagagctacccctgtaacaccaagcagcatttctatgaattgctctaatttccaagcgttagccatatatgcccgtaagctaatgaggtatgaaatcgatatcctcatccggacagcttttcagcatcgcatatacatgggcactgctttccatttcttcaataagatcaaacgcatgatacacatcttctgctcctgccacgattccgtgatgtttcaacagcaatatcttcggttttgtcttcgttttatccttgaaatgacaaaacagtgcatcacttcccggcggcgcatacgcaacacatgggatatttccttttgtttgcataaacagataaggagtatatgcaaacaggttcctgacatgagactccgcatctgcataacaggacagtacggtagcataaaagctgtgtgtgtgaatcaccgccttatacgcctcgctttcttgatacaatgccaaatgcatgggatattccttgcttggctttccatacagaatagtcccctgcatatccacctgtgcgaagtcttcctgccgcaatcttccaaaacagcttccgctccttgaaatatacatacgatgttcatggagaaagctgatatttcctgtcgagcctccaacaagtcctttttgaaacaaggtatgcgcactccagatagcggcatccagcttttcctgtaattcactcatgtgtgttccctcctattgccttgatgaagaaatcctctgcaccgaaattaccggatttcagaataagagtaagacgctcattcttcaatggaatcagttcaggaacaccgggatcaacactttttccgatataaaatccatcaaagcccagctgctgtatgacagccccggaggtttctccgcccgcaactacgatacgttcatatccgaacgacaaagcagcactgcttatctcccccatgatctgttctatgcacttcgatgcttgatcgaaggtttcatccttttttagctcacgcatatcctgttccaccgcatcactgtatatcagcaccggctgtgcctgttggtttgcatatgtcagaatgtcttgggcggtaagctctttattcatcacacggtttgcatttacaggataacagcagccatgatgctttcggaaatacgcaatctgccttctggtagcagccgaacagcttccacatagcaaaatcgtccgcccgtgtttccgtgtctgatttttttccggatgcagcaaagcatcgttctctaagacatagggaagcagaccggatcccccggtaagaacaggcagctccttaaacgcttccgctatccgtattccatcctgctctgtttcataatccggcacgatataaaacctctcatatctgcatttcaacgcatgtatcgtttgtttccattctccctcacaaagctccttctgccgcataataaagcaggggtatttgctttgcggcttcatcagattggggatataggaatcccacattggattcaagggatgatttttcaacggactatcacttaatttttcaccattgacgtacaaatttccatcctttactatgcgctgattcacgggtaaggaggggcatagaattgtaaagggctgtgccagatattccaataagaaatcagctacaactccgatattcccctgaggagtggagtcaaaggttgagcagtatttgaaatatattcgttcacatccgttttcctttaggaaatcaacagccttttttacttccgcaacagctgcatggggagtaacgctccttgtttttaaagcgataacagccgcatcacatacctgcagctcgtttggaactgcattgtacatgatggtttcagcaccgcttttttctaaaaagctggccgcgtcccctgcacctgtaaaatcgtcagcgataacaccgatttttatatttttcgtttccatatatagctcctttttcggtaagaaaatgctttcccgtttacaggaaacagttcccagttcaggaacgacttccatactacgggaactgctgtacgcttcctttacccccaggcctttccagcctgatcaaataattcaacataatgagccaatcgatccttatacccttttttgaaggcaggaatcagcttccatttatcaaaattcggatccttgatgaagccctccagctcctcttttcctgcaacgatcagctcagtagccagattaaccttctgaattcctgattgaactgcttttctgagattttcatcccccgttccacttccgccatgcagaacaagcggtgtatctccacatgcttcaacgagctgttttaatcgctcgaagtcaatatgtggtgttcccgtgtagcgtccatgtgcggttcctatggcaactgccagacaatccacaccggtttccttgataaaatctgccgcttcttttggaacggtaagattatttactccgtctacagcataattgtttcccataccgacatgtcccagctcggcctcaacactgattcccagcggtctgcacatttttacgacttcctttgtctgctccacattttcttcataggataggctggaacgatcaaccatgatagatgtaaacccggaattgataccgagcatgatatcctcataggattttccatgatccagattgattgcgacaggtactgacaccttttccgcaaggtctcgtatcatatgtataaaccagggaagatccgtgtgaataaacgcattgacatctacaatcatgggcgcatggtattcctcagccacctccagtacagcccttaccgtatcctcactttgtacattgggggcagtaacaccatagcctcctttctttgcatgatcgagtatttctttcattgtaactaacataataagcacccttacctttcgttatcctctggcctgcagttatcaccctggccatatataaagacgatttctacgcatccaccttcatcatagtggaaagcatgccactcattctccggaatatgcagaatcatcccctcctctaatgcaatggttctttgcaaatgatgcgcatcactcccccaggatacatacccgttcaccgactttgtgatgatcacggtttcctctgcatgtgcatgcggctccatgatgccatactcttttttgtataacgcatatcccactgtcattttatcgctgtcaaagcagctgtttttaccaactgcgcgtatcagtccacgtccgcaaagtgcatccacggtgatgctatttttatttatatactccatacagactcctcgctttccctactcatatctcctgcagctgcttaagacccaatggcagactcgttactattttctctctgccctgcgtgatatactgtatcgcattcgccatacttgcctgcgccagtacgatcacatcatatgtattccagtgctcctgtatcacttctgcgattttttgatcatgccgttctctgtcaatttcatatagttcaaacacatcgggtatcaggatacaggtgacactttgctcctgtgacttccgcttgcttctaatcaaatcggatgtcggctccagcgtacttttcaccgttcccagaacgaggatgttatttcctgagttcaccgcttgatccgccattggctcatcgattttatatagcggtatatccaggagctctctggcgatatccgctgctttgccaagagaagaacaagccagtaaaagcgcgtcacttccattgtttttcgcaatacatgtatattgaataaatcgctcgattacggatgcactcattctcccgctgcactttatatcgtttagtaaagaatcatccaacatgttcacaatatcaaatttatctggatacagctcccgtatcattgcgggtatcgtagtggttgtcgcaagggtggtgtgcaaaatcgtcaatttctttcgcatatagatttcctccttttcccgtcatgaatacttcattttgaagtctaaacgatatgcaccacagccatcataagggaaagaacaaagattccgaccatgatccagttgatatttacatttttatcaagcagttttttacaaccgaacgtcagcaggagtggaacaagtcctaaaaataaggtatccaaggaggactgtaatgcgaccgcttctccaccaggaatcggaatggaaatcgctgttgtaaattttacagtagatgctgtcattgcgccaaccataatcagaccaagtataccggcgcattttgtcaatatctttagggtaccattctgatacatattcgtgataaagctggaactgctgataaagccgacatatcccaaagagaagcgcagtgccatcgtacagccgttataaatcagaaagaagagaatcggcccaagaatagaaccctgcaatgcaaagctgataccaattcctgccgcgatgacacgtacgacactgaacagcagggaatctccgattcctgccagcggccccataagcgctgctttgattgcgacgatggagcttgtatcaaagtcatctacttcactgttttctttttccatggaagcaaccagtccagccaggaacggatagatagcattggatacgttacaaaattgaacatgacggtaaagtgcttcttttttcttttccggctgatctttataataacggttcagtgccggcataatctgccacaaaaatccaattgccatctgtctggcctgcccgcctacccttgaacaatgtgcattcattgaacgccagcaaatggaattgatcattttcttatcttctcttgataaattatttgtcagtttcattgtaagaaatcctccagttcctcatttgaatcatttttgtcagcacatgcgattgggtgctgtttcattctattgatttcaaaatcacgcatggctgtcgctaccacgataacgataccgatgactgcaatcgcgatgattggcagtttcatatagataaacataacgaagccgagcagataataaataccgatttcctttgtccagatcattttcatcagcaaagccagaccgactgccggaagcagctgtccgcaaacggtaaggccggtcatgacaacatccgggatggaatccacaaatgcttcaactgcattgtagccgacatatacaccgaagaatacgatagcagcaaagaacagatttttagccagccagacgccaaagttcaagtagatgagaagtcctctttcatttccctcgagtgcccatttatccattaaggttgtgaatacagtcaggaaaatattatttacaaacatcgttacaaatcccatcagaattccgataggtacagcaattgtcaaggctgcctccggatccagtgtggcgttggttgcgaaggctaccgcaaatacggttgccgcagaatgatctgctgatatctgtccaccgatattgacagaccccataaatacagcctccagtgttgccccgattatcagcccctgttgcaaatccccaagcaagagtcctgtaaccgccccgataaagattggtctgtctgacatgctttgaccaaacatccagtttccggcataacagatgaaatatgacaatgcagataataaagcgacgtttaacatattcaattccctcctttaattgttttccagcagctttttcacactgattttaggatttgtcggtataacccagtgaatggtttccatatcaagcttggcgatttctttcaatgcttccaattcctttggtgtacagccgacatccgcattcagctgcttcttttccgatgctgcttcaaagcgtccgacattcgctacatttatcgattccaccttgcaattggtagcgattttcaaagcatcctgaatactattggttaagacaaacatcttaacagtctcagatttgggattattaaacaccttgatggcatcatcaacactgcgaattaaaaccttcacgccatttggagttgccattttcaatgtcatctgctgtacctcattttttgccgcctgatcatttgccactaccagatgattggtagcgaaatactttgaccatacgactgctatctgcccatgaatcaaacgatcatctactcgaatttgaattatcatacgttcctccttagatgcagcttttataaatcgctgctaaatcattgctgtttaatacgcagggtgaattgacaagcagccgctgttgcttttcatacacgctgactgcccatgtgtcacaaatcccctcatcgatccccaatgctttgaaatccggacatggatagatttcagttaacaacttttgtagtcctgaaacagaagaaatatctgctggcagatccttcaaagcattttcaagcttgtatagtggtatattctttttttgatagtattgcagagtctgtgcaaatacggcatagactgcttctccatgggcaagctgacagttcgcacccaaaggaaaggacagtgcatgcatggtggcacatcccgctatactgaaagcgactcctgccatattggcacagatcagacttttctgcatatcctgagggagcttctttgtttttcgtgtctcctgcagattttccacaatacctgaaatcgcgcttctagcatacatatctgtataggggtttgccttgggtgaaagcaaagcctcaatcgcatgtgccaatgcatcgatggatgtgagtgcaaatgtcttatacggcagcgaggtcagcagttctccaatcagaatcgctttatccgggaacagtgcatccatctgcagaccaagcttactgtgcagggaaggaaattccacaacggaaacattggttacctcacttccggttccacaggttgtcggcaaagcaatcagctcccgcgttttgcgtacttctcttttatcgctgtacaattcctgtacggatcggccatcaccgaatacacaaagctttgaaacatcaatcacagtaccaccgccgattgcgattattcgctcatatggatacgcatttgctacttttaatatgtcatccacccattcctctttaggctccttcgtaccgtacgcatccatattcagaagaacagcctttcccaatgcatttgtctctttgatttttttcatctgggaattactcgtgattaccaaatcagtttcctgcagctttaagttcttcaaacagatgttcagatcagcttcctgatagatttcccctttcatacgaaatagcagatgcagctttgtctcatgcgaagaattcatcctcatcaccttcctttgtctcgcatgaggacatcttcacaagctgcaactgacattccttcagcatgctttccatccgttcagcagttaaactatcatcggtcatagccgctgataaaacaatcggcagattcataccggtaacaatcggaatatcctttccgctttccattaccattgcactaacctgctgattcacacttcctccatagatatccgtgaatatgatcgctttccccacttctgcagaatccacaaacctctggagctgttgcagataatcactggaagtgtctacataagcatctaccgcagcaatcatttctgattgtcccaggaaaaactccaaggtatcctttaatccggaagctaatctgccatgcgacgttaataaaatccttttcatttcatcacctctcgtccactttatacatctatataaccacaacttaacaacaatttcaacatatttttagtattttattgttatttttgttattttttattttcatattttggataaattggtattatgaagaataaatttggttattttataggtaaattgttgttattttcatatcggtttgatataatatactcagcaaatgcataaatttatatcatttataagctggagggaaggattgcatatgataaacagccaaagaaaaaaagagattatagagtatttaagtgatacagattaccgaacattaaaggatatagctgataaatttgctatatcgatgaatactgcacgaagagatatcaatgaattagcagaggaaaacctggttaagaaattttatggcggcgtcagcctggctaggaaaaaggacagcacctttcaaagcagaatcgcctcacatatcgaggaaaagcaaagaattgcgaaatacgctgcagcactggtgaatgataatgacctgctgtacattgattcaggatccaccacttccttgttgacagattatctgcacagggattttcatttaacaatcgttacaaacaacatctatgttattacaaaggtgatcgaggtcgtgaactgggacttgattgttgtaggatcaagattgaagcattcttcctgttccctcataaacgtgtatgactgggattatctgaattctttaaatgtaaataaagcttttctagccacaaccggattaaccatacagggtggtgctacaaatccggataatgcggaaacaattattaaaacaagcatgatgaaaagaagtcaggagaattttctactgaccgattcatccaaatttgatcgaacttccttaagaaccttcgccaatatcgaggacttcgataaaattatcacatccggatctgtaccaaagcattttgtagaatactgcgcagctggcagcacacagctcatcattgcataaggaggagcaccgtatgaacataggctgctgtattgccacaaaggacatacccctggcaaaggaattcggatacgattatgttgaattatccgcaaaagaaattatgaaaatggatacggagctatggaaactaaaacgtaaggaaattttgcatccgggtattccggtattgggcctcagtgcttttgcagatgagcagacgcccttgattggcccatccgcacaggaggaggtctggagtgcttatttggatatattattggaaagagcctcatagcttcatataaaaaacatcggtatcggcgctccaaaagccagaatgataccatcggagtatgattatgggcttgcaacacgggaaatggaatattttctatatacggcggctaggaaagcaagctcctatgatatcacgatattgtatgaagcgctgcatccgaaagaatgtaattttggtaatcatacgcaggagtgctatcaaactgtacagcatatccattcaccaaatctgaagctggtatatgatgtatatcatgcgataaacgccggtgaacagtatgcagacagccgtatgtgctttgatgagataagacatgttcatatcaattcttgggatcaaggactgcaacgatatttcttatttgaaaaggatttaccctatgtaaaagatctctgtgtatttctgcaatccgtgggatatgataacacgatttccgtggaagcctttgatgcggatttcccagaaacaggggctgcctcggtatctattataagggaggcgttatacgaggcagaaatcaaacatccattatcccgtacaccttctctttgatagagctcacctttttctaggttcctaaatttttttcattctctgatgaaatatgaataccgtatgcatcaatttctacgaagagtcaagcatagcaagaaatgtatacttataaggtggtaaagcgatcagaggatattgtgtctgtgcagtgctgtaaaacgaagaaagaaaaagaatgatttacatagcaattcagatatatataaaaaaagggtattccgctctattgtcaatcggctggaatacctttttttgctcataactggtaggaagctgtttttttagaatattgcagggttaacttcgaatagcctgtgcgaaggctctttctgactttcaaatccttcctatatctgttgcagtgcctgttccccatgtatctgtgcctttttctggctgtgcagcatacaccatatactgaccaccagtgtactgctttcacatacaagcgttgcataccagattccttcaccctgaaacagctctcccataatccatatagatgccgcaatcagcacaaagccgcgcagcagcgatatggcaaaggaatagccgcttttctccacagccgcaaaataaccgctgcatacgatattgtagccaaggaccagatagcacagagaataaattcgaaaggcatgaacggtataggtgaacaactcggctcgtgatgcatcaataaaaatcgaaacaagagccggcgtcataaacagacagattgccagcgccagcattgacatcgcaaacgtggagtacagggcatagcgcaggaataaacggcaggtgttttcctcccggcgccctcggtaaaagctgaccagtggctgcatcccctgtgatattcccgtaaaggtcatcatgacaatattgtagatatacgtgataacagtataggtcaccactccgttatctccgatatgctttaaaattgcatgattgaacagaaaaataatcgtaccggcagacagctcggtgataaaatccgcagtcccgatgggaataatacgcttgtaaaccgataagtccatcgttgttttacaccagtgaatcgtccctcttttcccaagaaaatgaatggtaaacacggtaaatgtcaaaacctgggacagaccggtcgcaatcgctgctccccgaatccccatccccacatgcacgaccagcacatagtccatgacgatattcgtcaccgcaccaaccgatacagccgcagttgccagctttgggaatccatccgttttgacaagcacctccatggaataggatacgataaagaaaaacgtaaaccagatcagcacgccaagataatcatggacatagggcaatgttacttcactggctcccagaaacagggcaagttcattttgaaataccagcgccagcaaagtgatgatcaaggcacagacggtcagaaaaatcgtgttcctcgtgaatgtttcatttgcgcttttcatattgttttctccacggaagatggctacaactgtactcgttccaacagagaagagaatggaaaatgcaaagatgaaattgacatatggcatggagatattcactgcggaaagtgcatgctcgccaacaaaacgagctacgtaaataccgtccaccatcgtatacagattgaagaccagcatggataccacgctgggaattacaaatttaaaaaactgctttttatgattcatattataacctcacttgcatagatatcataaaccctggtataataccagagtcaagaggtaaatatgaaaacatactataaaatcaatgaaatttcaaaattatacaacatcggacaggattccctgcgttattatgaagagcttggtattcttcatcccatgcgggacaaaaacaactaccgccagtataccaccagtgatattcatcgtctgaatgtgattcgcgatcttcgtaatctggggttttccatgaaaagtattcaggactatctggagaaccgaaccatcgccaacagtctttccttcatggaggaagaagagcgcatcatcaatcagaagattcaggagctttatcagctaaaggttgatattctgcatcgcaaggcgtcactaaaagcgtgtcagcagctgccgatggaggcgatagagctgatgcgcctgcctcagcgcaaatgtgtagccttaaaaacggatgctgttcatgatgatgtggaatatcagctgatgaagctatcaaaggaatacgaaaaaaacatttatacgattgcaaattttaataccggcttctttctggatgtatctgatcgtgaacatattcacgcttcctctgttttcattgcgggggaatccctgcaggactgggaattcacactgcctgccggaacctatttgaatctttattatcagggtgcacgcgataaagcgcatgagcatttaaaaaggatgctgaaatactgtgatgaaaacggatatgccattggacgccatattatggaattcttcgttatcgatacgcatgagacccgtgtgcaggaggaatatatcacgcagctgcaaatcgaattggaaaatatatagattattggtataaaactgtacagggcacacagctttgtacggcttttcttatcgtcttttcctttagcaggtaatgtcatacaggaagaacttcatcggtgcctgttgtccggccagcttcacaaccatctctatttctcctcttcgctgcattccacggtgctcataaaagccgtaattacagctactgtctgtatatagtagataaaagctttgaatattctcctgacgcatataagtaagcgcagctgcatagagctgtttgccgattcccagaccacgcacagcttcatccaggacgaagaatgacaattctccaccataggttttcccgctaccgtctaacagcacctgatcaacattccgaatcttcccgtaaaaggaacagatttctctgccttctcttgttataagcagatgcacaatagcaagaaggctttgcagcttcagggaaaacggacagcggtgcttctgtatatgtataccacagggctttccgtcaacgatcgccacggcagtgaaggtctgattggctagacaggagtacaaatatacatgtgccagtctggctgctgtttcagaagaacagaatgcatcatatttccaggttttgcgtatcacatcctccagagcaagtgcatcctcctcgtaaaatctacgaatatcgacagttttgttcatgatgttcacttctcctttatccttcattcgatcaggtgtagaatcatcttaaagtatccagtaactgtaaagtcaagaagaaacatgccgattttttgtgtattcggacggctagtatgccactttagcgctaagactatttccagattcagttctgagactttccacctactgtacactatacactgaataggaaaaggaggtgccgaacgaatttttcgagatactcctccttccgattatgatcaagcttttacggtgttcttgtcctattgtttctgctgctatgcttccgagtgaaaaagtagttctttcctatgaatgaggataactgaaacagctgtttttttttactatgtcgaatactggatatctcatctgatttagcgctgtttcatcgctatacaaatcatgaagagatcacaaagaaaaacagcagtcatgtaccggctgctgttttcattcatttacgtatcataggggctctgttgccctttatcgtataagaaagcttagcaactgcttccagtgtttcctgcatacagctgcgtatatcctcgcaagcatagccctgctcttcacattccgaaaggaattcttctatgacttcctcataacggtttttatgctcagtgttgcgttttttccagttgattccggcaaaggcaggtaggatattccagttcacagaaagaattcccagcttcatccatactgccagaataggatagcctggataatgctgccaaacggtcgcattgtcattgcttgaaacctcatcatcatgaaatctgacagtatacgtctttgcataatcgctgctgtcaacaagcgcctcctgctccttcactacaatacggtcatctgccaatgcactgtatgcctcatatacctttgctatcgggggtagcttttccacatcatcaccttctttctattagaataccacgatatatactgcctataaagcagttttccactttcccacattgttttccacatttggtggaaaactaaaaaaagaccgatacctgtgatgaaataccggtcttgcagcgatttcctttccatgaggaaagaaagcatctttctttcctattctttatacattcccatacaccgccataccatacgatatccggctgccagatactgcatgatatggaggcttcaccgtacaacgtatctgaaagaggagggacgattgcactgaacggcgtctatgtggaatgcctgcaccccgtaagggatgaaagaacctaaataattgtttcttctgtttccttatcgaagaaatgaaccttgctaagatccatagccagctcgatatcctcatgcggtcttgcttcaatgcgggccgctacctttgcctccagacgctgttttccaaagcgtccgtgcaggataaactcatgaccgagcagttcactgacctcaacatcgaacatgaaatgtgaggtaggataggtgtccgcaacaatgccttcaccatgcagatcctccggacggatacccatgacaacctctttgccgtcatacggcttcatagcctcgtggaacatatccggcatttcgatgcgctgatcgttacagataaacgcatttccctgataggttccctgcaggaagttggtcgcaggtgcccccaggaatcctgcaacaaacatattcttcggattgttgtaaatttcctttggtgtaccgatctgctggatataaccggccttcatcacaacaatgcgatccgccatggtcatcgcctctgtctgatcatgagttacataaatcgttgtcgcattgatgcgctcatgcagcttgatgatttcacttctcatctgtacacgcagcttcgcatccagatttgacagtggttcatccatcaggaaaaccttcgcattgcggacgatggcacgccccagcgcaacacgctgacgctgaccgccggataatgctttcggcttacgatccagatagtcttcaatttccagtatacgggcagcttcccgtacacgcttgtcgatttcttccttcggcgtctttttcagcttcagaccaaacgccatattatcataaacactcatatgcggatacaatgcgtaggactggaagaccatggcaatgtcacgatcctttggttctacatcattcatcagcttgtcatcgatataaaattccccggcggagatatcctccagtcctgcaatcatacgcagagttgttgattttccacatccggacggacctacgaatacaatgaactccttatccttgatttccagattgaaatcaaaaacggcctgtacattattatcatagatcttatctatatgtcttaatgataaatctgccattttacttcctccttcttatttgtactttcgattgtatacatacagctctgcgagcagtccggccagtccggcaatctccaatcccagatttcccaaaccaacggttttctgtccgatgacgatcatgccaaggaacacaaagaacagaactgccatgatgatattcttcacaatattggtttccattatttcatcaccatccatcgtatttccccaggctgcagtgtgacatgtttgcagttaccttctccgtcatacacaccggtttcctggatttcatttgtattattcaaaatcgcatactgctttgactgcggatatgcgtgaacctcacaatacaggttgtccgcataccatttcttgaatgcttcctccttgcatgccgcataatagagggcacgcagcaggattctcgtattctgggtgctgtatggaagtcctgcaatatatacacagcgtccttttccatacgcatgggctgccatgttcacttcgccatcgttatatgcgatgatttccgtatcctcatacagcgcatagatattcttcattccttcaccgaaatccagcggctccacaacatcctctgttatgaagtgactgtctgccggtgtatggaaatatttgtccgtatgcagtgtgaagccaagctccttatccacaccgaatgcatctgccagctggaagaaacgtccgccatgctcacaggctgtcggctctccgataccaaccagaccatgtccgctgtatacccatgcccgcagcatgctaaccagcatttcatttttccatatatctccaccggagaatgccgtatttgcatctcccgcattgatgataacatcaatatccgctggaatgccatgctccagcagctcgtcaaagctgataaaggtaacatccacactggctccgctcaaggattccagcattccgttataggaataaatctgtttgcagtacagaccatgcgccaccatataggcatgccagctgcgcagcgctccccagtgattgagtatggctaccttcaatccgcagtatggtgtctgttcatggacgatatcataaatctgacggaattcctcacataccttttcgatgtattccacaaatttcgggaacttgtaggcaaggcttggataaccgccataaccgatacggtcgattggcttgcgcatgatggcacgtctggcactcagccagttgtccaccgcttcgatgaccggatcatttccttcatggaaggtatccgggaagaaatatggaaggaatcgtccttcatgatatttcacaccgggtatatcggaaatcagacgaagggttgcaccgccgccgacactgccgaccacggcatccaaaccgatggaaggaaaatatgcgccatacggctcggtaccgatccagttatcaccgagaaacatcattgcttccttgccggcttcatgcaccagatccaccagctcttttgctcgttcgcttacgaagcgctgtgtaaaatcgatataatcacggtattcctttgtcggaacacagaacgtggagttataataaccgttttggacaaatacctccggacgcaggcgatagcccaactcctgttcgaatgccagtatcgcttctgtcgatacgctggcaccatagccgcaccagtcaacgaatttttccttcgcatgctgattgaaaatcaacgtgaagtgatagaagaaggttgtgaatcgtacgatatcacagcgcttgttttcttcctcctgcagccagtgtttcaaatattccacaacatagtccctgctgtagggcttgcgtacatcaaacggtatttcatgaggcttgtcaccccagtcattggtgatgtgattatacatctgcgtcggatcccagaggatataggccagaaagctgacggtatattcatggaacggctgtgcatgatgcacaataaccgtatgatgcttttgatccagctcccagtcatctgctgcaaccacagctccgctggtacggtcgataacctcccaccactgcttgggatcatggtcataatccggtgtaacctgctgatcgaagtattccgccgcaaatgcaattcgaacatcttcaccggctgccagtgtatatgcgctcatcagatagatctgctggcattcctccatgtgctgttcagcgaattcattatgtcctctggctacgaaatacgtggtatatatctttgcatccagattccggattccttcatcaagctttgtgccgtcgctgtcacggatcgcatccgcaccccagcgttccagcaaatcctttgtttcttccagaaaattgctttctccaggcaatgttactctgccgaatgtttttttcatagtcgtgtagctcctaatctttcagacctccaaggctcataccctgggtcagtttcttctgcacacagatgtacagaatcaatgttggtaccataacgataacaagaccggcatacatgacaccgtaattcgcctgtgaacgctgatccgccatcaggaatttcaacccgacagccagtgtcgcattgtccttatccatcaaggtgaacgccatgatatattcattccagaatgccaggaactggaacagaataacggtgatgatacttggtctggccatgggaatcatgattttcgtcatggttttaaaatagccgcagccgtcaatcagtgctgcttcctcatacgccttcggcagcgtcttgaagtagccgctcagcagataaatcgtgaacggaagactggtcgctgcattcaccagtgccagcatgaccttattatttaggaacacctccacaccgagcagctgatccgcctgaaacagcatcagataaatcggcagcacaatatagtttacattgacaaacaggcctgccataaacagagcattgaagaatttcttgcccttgaacggatatcttgccagaacataggatgcaggcagtgccagcaccagcaggaaaatcagaccgagcacggtgacaaatacggaattgatgaaatactctcccatgcgggccttttccatcgcatcaacgaagttactccagagaaactgcgtcggcatggaccatggatcgccaacgagatccagctgtgatttcacactggacagaaatacccaggcaaccggaacgatgatgctgatggcgaatacgatcatcgccacgtagacgaatatcttataccaggcatgagaggacatttttttcttattcatagctcacacctcctagaattccagaacatcacgttctgtgattttgttcagtaaaccggacagggcgaaggagaagataaaggtgatgacaccgattgccataccataggaataatttcctccaaatgccttgttgtacatataattcagcggtacttcacttccaagatctccattcgtattgatctgaatgaacatgaagcttagattgatcgtggaaataacgaagaaggtcagtgtcgttcggatgttgttccagatcagcggtaatgtgatcatgaagaactgctttacctttcctgccccttccagagcagccgcctcatacagattttccggaatggaggacatgctggccatatacataaccatgtagtagccgattgcctgccacaccagtgcaaagatgatggaatacaatatgataccggaatctcccatccactgcttctgcagcataccgagtccgatcatttcaaggaagctgttcagcagaccgttatccggtgcataaattgccgagaagataccggcaataacaacaatacttaaaatattaggaatgtagaagatgacacggaagaagtttttccctttgaattcttctcttgtcagcaaggtcgcaaacagaacagcaagtacgacggtaaacagcgtcaccatcacaatgatcagaatcatgttctgcatggattcaataaaacgtgaatcggtaaataaaattttaaagttgttcaatcctacaaacggggcatcgccgacgattcccgttttcccgtacagagagtaacggaatacgttgaaggtaggaatcaccataaagagaatcacaagaataacggccggtgccagacaggcaaagacaaatcttctctgtgctttctttttattcattacttaaccctccttttctaaaaagcagtgagcgattcgctcactgctagttcaataaatcatgctcacaaatttattttactggatgctcactaatcgttttccaagttttcactaattcactgttccacttttcagcagtagtcttaccagtattgatatcatcagctgtgaaacataataccttcttcatgtctacatcagggatagctgcagagtcaaatggtgcaaatgcgccgataactgcagtaacattctcgtcattgtatacattgtacagttctttgttaacgcctgtcagcttatctgtaataccgttaacaggtacaacacagttatatttcagcatgatgtttgcgccttcctcagaatagatgaatttcagaaatgcttttgcgtcatccttgtttttagcttcagaaggaatccagcactgctctgtaaaggtcgtgatggctttctttccgtcttttgtcagtgcaggtactgcgcttacgccccatttgaagtcttttggagttgtttcttccatttcagcaactacccagcttccgtttggcataaacagagccttaccgtcgataacagcctgctggttctttgtgaatccgtcttttacgtttgcattcgcaaccgtatttggttccatgtaatcttttacaagacgtccaatcgtatcggtaaccatcttaccttcttttgagttccaagcctcagcatcatagtttaataacttactcagcagctcctgtccgccggcttcctgaataacagaaaggattgtgttatccagatatcctgcctgtgcataggtaaacagagaaatcttgccttcttctttcagctggtcaccaagcttgaacatatcatcccaggtctgaggaatttcatatttctttccttcgccaaccaggtttgcattgtaatataaaccaccaggtgtatacatgattggtgccagataatttttgccgtcaccatagaactgagataccgggttgtttacgaaatccggattgatgtttttcttaacattttcatctgcgaatacatcagagatgtcttccaccttcttgctgttcagctgcgtttctgtaaactggctctgctgtcccaggttgtaataaacgatatcggaatattcccctttgctgttttccttgttcagaactgctggtaagtccttctcaaaacgaagctcaatcttgacatctttattttttgcttcgaatgccttcgccatttccttccaaacttcttcaccgtttcctccagagaacgcatcaaatttaacgatacgtttttcgccgtcactgccagaagatgcatcatccttcttgctgctgcagcctgtaacaacgcttgcggccattaaccctacacaagcaagtgctaccatttttttcataatgaatttcctccttcatctggatatgttttccatacctaaatattactgaatgtaagcgttttatgcaatgcatatattgttctgttttttatagatattgcttttcaaacaataaaatgcaagaaactgtaaatcttttcagaaatcacgttttttacatttctttacattcaaagacaaccatcattatataagataaatcgaagaaaataaatagtattcatacagttattcttcgatacaaacaaaaatacaagaaattttaacaagaaataccaatttacaagaactacatataaattaaattcctttttattgatgctgtatatgaagtcagtacttataaaatagctgtacatgatgaaagagcaggctagcaacaatcagaaatcaggtgacaaattgtttgtcagaaaacatacagtcagcaggctgcacaaaagcatagccgctttttcgcacgacattccacaccctccggtttccatttttcccattttttatttttgtgtcaaaatcgtgctatactatagatagagaggagggattttcatgaagtacgccagctatctctattatcttctatatccgtatctgatgctgttatctcaatatcctattcataccgcctataagaacatgatgcaaacatatgatttcaccgagtactatctcgtcttcagcactgtatttcttctgactggtatctccgtattcctcctgtatcactgttatcaagcgatacagccccgtatacgctatggaattgagcttgtaaacctcattcttttcggctcgtacgtttacagctttttcagtgggaatcagcttctcccggtattctccatccttctggtcagtgactttgctcggggattgaccatggtgtacgccggctttactctctgtgatgttatcaaaggcgccatttcaaaaattcatcctgtttcatagtattatcatacggtatccgcagaggatacctttttcaacctgcaggtttcttgtccagttttttcatataattgccacaaagaacgttacacatttcctttttccactctttcctatataatgaacgttagaaggtgaaattatgaaacagaatgtgaacgtactattgattgtctgtgatcagtttcgcggggatgctttatcctttgcgaaccatccggatgttaaaaccccttatctggactccctggctgcggatggtgtctttttctcccatgcttattcagccacgccaagctgtatccccgcacgggccgccctgatgacgggaagaagtcaaaagcggcatggacgcgtcggttatcttgacgaggtggagtggcgttatcagcattatatggctgaggaattttcaaacagcggctatcagacgcagtgcataggcaagatgcatgtacatcctccaagactgacctgcggctttcagaatctgcagctccacgacggttatctgggctgttatcgcagcctgaatatcccgcactggatgcatcaggatgtcagtgatgattatttgcaggatctgcgcaatgtgctgggagaagatgcagacatcaataccagcggagcggaatgcaattcctgggtaacgcatccctggatttatgaagagcgcctgcatccgaccaactgggttgcagataaaagtattcgctttttaaaaacacgggatcgcacccggccgtttttcctcatgtcctcctttgttcgtccgcatcagccattagatcctcctaaagcatattttgatatgtataaggataaagagctgcgctcaccggctagcggtgactgggatccgcaaaacggagcaggtgcggctggcagaatttcagactccatatacggctgctgtgatgctgctatgcgaaaggatgccatggccggctactatgcggcaatcacccatgtcgaccatcagctgggccgcatcctgactacgctgaaggaagacggcgtctatgacgataccatcatcctgtttaccagtgatcacggagagatgctgtttgaccataatttatggcgcaaggtctttccatatgaaggaagcacccatattccgttccttgtgcatatcggtaagcatatagcggatatcgtaccacatactatcaatggcattacggagctgcgcgatgtcatgccgacgctgctggatctgtgcgggctgcaaatccctgatacggtggatggatgctctttgaaaggctgtatcctgcaggaagccgaatctgtgcgaagctatctgcacggagaacacagctttcacgataagctctccaatcattatatcgtcactcaacaggataaatttatctggtacagtgaaacaggcgaggaacagtattttgacctgagccgggatccgcaggaaacacacaacgccatcctggatgaggagtatcagtcacgtataagcgagcttcgtggcatcctcattcaaacactagagaatcgagaggaagggtttagcgacggcaccagactgatctgccgcaaggcacaggacattctacagaatgtgcatgattactaaccgcaggaaactgcggtttttttatgccctaggcaacttgctgttgatacatacagcggtatgatggataacgtgctgcatatctgtttaccttgaagacctcaccctcatgataaagtccaagagccaaagcagccacaataaaaaaacaggcgcggcatgcatatgaatggaaagcacaggcagcctcctgtacaaagcatgagtagacaagagtcgggtattccattgtacggataacaaccaagaaggtctgcgccgatatgggttccttcttactttaggtgttggaaaagggagaattcaacttctattgataattacaatagtgttacattctccctgttttaaatttaccctcaattgagtaagaacttcgatatcatcacagacattttccagctttcctacgcatgaaaactgaagcacatggtatccgagcgtttctaccgtccttttttcaccggatttttcggcttgtaaatacggaagataactccctctgccatattctctccgacaacctcatagccattggcactgacaacctttgccacaatcgacagacccagaccgaattttccgccctttcccatctcatacggcttaaacagcaccttcaggcgatcctcatccatacaaggtccgtcattggaaatggtcagaccctcttcctcactcagatggatatcaatcgttgttttcgcataccgcaatgcattttcaataatattctccacgactacgcgccacggctctgccagtccatcaaagtaaacctcctccagatttgtcaggatctgaatatccgagcggatgaatctggtgttctgcacaaccgtttccacgatttcctccatattggagccgattccctcacaatcctgagaaatcagatattccacgcggttcatgaacagcagggaatgtaccttctgttccagccggtcggcattttcaataataacatcgacgcttttctccagtgtatcatacggataaataccgtccttgatactttcaccgtagcttttgatcgtcgcaatcggtgttttcaggtcatgggaaatattgtgaatcatttcttccttcgtcttttcctgcttgcgcagctcttcccgcatgcttacaagtgcatccgccagctcaccgatctcatcccgccggtttacacgcaggtccgcatccttgccaagcttgacacgttcgatatagtttcgtatctgattcagggggtgaatcagcgtcagtacccacatcatcataatgatgaagaagaagccgacaactatcaccgtgatatagacaacgctgttaatcagtgagctctccagcttgcccatattgtcgctgtacatcttgctaaccagcagctggtcatctgccaccttgtaaatactgtagtaggaatcccgatctccgctgaccttcttcacgatcccgtgatgaatcttatcgcctgccgtataacgggcattgatactcagaatgtcctgtgcaatggctttccattcggagctgttcaaatccatatccgaggtgtttttacctgccagcgtaacatgcgtggcaccatccagcgtcttatccacccgcaccataaaaatatcgataccggctgcggagttgatcagctggcgctgttcatcattggtactatcactcatagcccagctttgcagcgtcgaatccagagtaccatacatctgttcacgtatcacggtggtcacattgccgttgatgtagacaaagaagaagaccgcaaaaaatgtgacaaagaaaaagattagggcaaacagctgctgtgtcagtgacagccgcttgacaaattcattaaaacgcttcattatcctaaacggtatccgtaaccgtaaatggtatgaatgttcagattcggaagcttcttacgcagtcttcgcagcgtatcatccacaacacggtcacttccgaaataattttcctcccatacactggtcagaatcttatcccggttgaacgccattcccttgtttttgataaacagcatcagcagatcaaattccttggttgtcagatcgatttccacaccgtgatcaaacaccttgcgctgttcctcatccagctcatagccgtccaccataatccggttgttgtcatccttatagacgcgcttgatgacattgtttacgcgcagcaccagctcctttggggaaaagggcttcgtgatatagtcatcgcttcctttttccaaaccgatgatacggtcaaattccttatctctggcagacatgaaaataacagggatatccctcccctgaaggcggatttcctcaatcagatcaaaaccgctcttgtcatccagcatgatatccagaatccataaatgcacatcatcatccattacatgcgcacttgcttcttcatatgtataataagaacgtacttcatagccttccttttttaaatactgattcaccaggtcgttgatggccttttcatcctcgacaacgcagattactttcttcattaacatcacctcatacccctattttagactaaattatgtgaaaaaaaaagctatttttcaaagtagctgcttttcacatggatttctcacatttgccgctgtgtttccactcaatttccgacatttctcgacatttcccgggaaacgtaaaaagactcccccaaagggaagagcctttcacacaatatgttatagtcctttttctttaatgaaatccacaatacggtttacatattccgcacacagtgcatcggttttggcttccaccataacgcgcaccagcggttctgtcccactaggacgaacaaggattcttccctcgtcaccaagctcctgcgctactgcatccactgccgcaagcagttccttatcctccagagcggcatgcttgtcatgtaccggcgtattgatcagcagctgcggatagataaacagatctgcacacagctccttcagggatttctttgtatccaccataatttccagcagcttcatcgcagtcagaagaccgtctcctgtattcgcatgagcatgaaagatgatatgtccgctctgctcaccgccgatggaatagtcatgctccttcatacattcaaacacatatttgtcaccgacagccgtctgctcatatttcagacccttggccttcagtgcgtgatacagaccaaggttgctcatcaccgtggtcacaacgacatcatcgtgcagaattcccttatcgtacatatagcagccgcagatatacatcgtgtggtcgccatcaatcaggtttccgtcctcatcaacagcaatcagacgatccgcatctccgtcaaaggcaaagccgacatggtaattgccttccttcatcatactctgcagctcctcgggatgtgtggaaccgcatttggtattgatattgataccgtttggcgcagaatgaatcacctcaacggttgcccccagctcgcttaaggtttccgcagcacagcttgttgcacttccgttggcaaggtccagcagaatgttcatgccggaaagatccatcggaacaatttccttcagccaggattcgtacagctccagaccttcctcccattcgatcacacttccgattttctcattgtgtgcaacttcgattgacacttcgttgtcgatatatttctcaacctccagctcaatctccggattcattttacagccgtctccattaaacagcttaataccattgtcatggaatggattatgactggcggaaaccatgattccacagtcgaaatgctccttctgaatcagacaggaaaccgcaggagtcgggcagactcccagcagatatacacttgctccgcaggatgtggcaccagctgccagacccatttcaaacatatcgctcgaaagccgtgtatcctttccaatcagaattttcgcatgacggttttttccatagtaccatcccaggtactgtccgatttttaccgccatatccagtgtcagcgtatcattggcgcgtcctctggcaccatctgttccaaaatattttcccatatgtgttactcatcctttcctattcgtcagctacactgcctgtcgcagtcaccttaacactaccattcttcaatacgtaggttgccagcttgttcttgccctctacgatcaaaggctgttcatacgtacctgctttctcaatctttgaaagatcgacatacacctgcagctcctctttcttgattttgctgatgatatccttcgctcccttgaccgttacatctacactggaggagcttccctgcgcaaccgtgaaattcagtccgtcaatgctgtttttaaaggcaatcggcacatccctgatgacccgctccttcgtatccgtcagcttgatggagatgttggcaatattgctggaaatcttcgttacaccgttcggcataatgatcggcatggaaatctcacgatcgctcgtcagtgtagaggccggtatggtaatcggtatctcgttaatgttatcgagcacagactgcttcgcatagattgtcacatgatccttatccagcttataggattctattgatttatcatttggaatcacaccggttggattcagtgtgatcggtacgtctttgcttggtttggttaccttgacactggctttcagtgtatccggtataatgtccaccttcataaggtttccatctgcatcatatgcaacgatgttcgctttggtttcaaaatctgttttcacatccttatccaccttgatcagtgcttttacaaatgcaattttatccagggtatcgctatcggagcgaaccagaacctcaccctgctgcagctgcggttcccccaggtcatatatggaatccatctgctggcggttgacgaagtcatagccgacggtaaaacgccgtatggatttcttttttatcgtaacaacgacggtggaaggctccagcacaacctccacacgcgcaggcatcgcctccgttgtcagcttcacctcatgcgtgccctcggtcagatcggtcatattcgctatcaccttgaaattcttctgctgtttaacgctcttgatatccgtcagatctccgatgatgcgcaccttgaccgtctccggcagaccgcttacctcataggcctgattcgataagacctgagataccggaaattcgcccagatcctcagcactcttcacattctcgagaaagttcgccccctgggaattaaaggtcacgtaaaacaaaatagccagtatcagcgcaacgaccttgccgtgcttctgattaaacagcagcttatccagccatccgctgatccagcgaaagaacttgccgaccttgatttccacatttgcataggttctggcaaacgtctgactcttttcggcaatcgccttggccagttcggtcttaccttccgagcttaattgtgttttcttttttttctttgccattaggaatctctcctttctttagctttctcaggagtttcttcatcctcatccgctttcacataatgcagaacgatcgcctcaggttcaataacatcattaaacagatcacttgccatattcgtcataatggttttccctgtttgctctttcggcggctccttcttcggttctgcttttttcttacggcgtgtttttttcacaggcttcgtttcctctgccgctttttgtgattcctcttttacagcggcagccggctttttccttactgccgtttttcgcttcttcggctttggttcatccgcttccgcagccgattcttccttcttctccgagtcggttacgatattttcaaacagggcgtccagcttctcatcctgtttctgtgtgaggtcctcgatatgcagtcgatccacttcctgttcaacgacaacaacatccttttccttcttatcctgttcttcgctctttttcttttttgtataacgcttgtctgccgcttccttctttgtccgcttgtttttccccttaaagtaatgcgcaaatacgcccggcttcttaccgtcgtaaggcggcggtgtgctgacctgctcggcaggctcctcctgattgtcatgcacggcagtgctttgctgcttacagacaacattcattaagaattcccgcagactcgcttcggaaattacggtcagcttaccaccctccgctatggaaatattacctgtttcctcactcacgacaatggtgatggaatcggtgatttcgctgattcccaccgcagcgcgatgtcttgctccgtagcttgtcggaagctctctggtcgttggtggaaaataggcagccgcacaggcgattttcacaccctgaatgatcacggcaccatcatgcagcggcgttccgtattggaaaatggaacagagcagctcgctggatacaacggaattcatcggtgtcccggttttgatatagtcactgagagaatgtccctgttcgatggatatcagggcaccggtcttagtcttcgacatttccgcacaggccttgaccagctcatccaccagattttcacgttcattgatcgtcagcgtggaaatacgggaaaacacattggttttaccgattttctccagaatactacgaatttccggctggaagataatgatgaccgcaaccacaccccaattcatgatggaatccgcaagatttgcgacggtgtgaagtcccagaaagctggcagcggaacgtataatgactatgagcagtacccccttgaatatctggatggtacgcgaattgtttttcacgattttcaggcagtaatagacaagtgcccagacacaggcaatgtccagcagctgctgaatcaattcccgtaaattgttcaaagtgaaataattgagcataaaaacactcctctcgtattttatattatagcacaaagtgcttcgtctacctatagttttctgatgttggttaagcctttcagaagcattttccgttctgaaaggcccgttttttattgatataaaagaagctggaataaaaacagaaaaatctgatacggaatgcatacttcctcgacacaacctgacaccatcatacagccgccttatattcctgactgtaagaaagacacagggcgctctcgatcgcataccgtatcagatacaggatgtatcctataccatgtaggaaaaactgctttaaaatcatcaaggaggactgcatccctcatgaaactggtacagtgctctgtagcatcataatccaaggtgtagcacaccttcagaaagacacagtttacaatccctaagcgcaacgccgaaaaacctgcagctaccttctgcctcacccggtggattgctgcatcgaacacccccaaaacttatgatcctctgtgaagccctccgctgcaaaacacagtaccgctgattatcgggcgccatttattatgatccttaagctttgcgtatccgccagaaagcgtacccttttttctttggatacatactcctgctgtcatacatattgacatgcagcaattcacgcatggcttgaggttgtgcagcgttacgcttcctcctgcatcccccgatataaacgaaactgcttttctaatagaaaatgataggcaatccaggatagaatacagctaatcgccagaagcgcaagcagccacagtggtatggaaagcatccctgtggaaacatgaaagcaggaactgagtaggtagagaacaaatttgaaacccacagctaaaacgccatatgcgatcaaatatgtgtaccatgcgcccagaatacggtgaaagctgcgccggttatgccattgtactagcacagtgcttcctagaatgagcatgatataaaacatgatggtcttccatgacacaaacagcataccgtttttcacatattcgctctcatcgattcccatcccgataacatcaagcagcgcccacaataccataagggaggacagcagcctccactagcgcagcagcttttccagccgtgtctcctgtaccgcattcgcacagacggcatcacaaaatttctgataatcgccaaatgcctcctctaccttgagtccgcgcgtttgactttccagtgccatagccagaatatcgtctcgaatatcccttgcgaccagcagggaaatgtccttactgctcagatagcgcagcatatcctgatatacgatcatgtattcatggttgagatttgctttgtcgttatattcattaccggtcatcattcacacctccttcaaacagcttgtcgatcgtttttgccagcttactccattccgtataaaaatcccgaagatacacgcggccttctgctgtgatctgataatatttgcgcctgggtcccagtggagaatcccttttttccgcacggatatagtgcagcttttccagccgcagcaaaatcggatacagcgttccttctgtgacatcaatccagccggcttccttcatattcatgaggatttcatagccataggtcatatgctgttcaatgattttcaggatacagccctccagactccctcgcatgagctgtgttttatcgtacatggactcacctctactttacgacacaaggtacttccttcatctatattgtaccacaaggtagtggagagtcaacaggaatcgtgaaggcagaagcatctctatgcatgcatatatgcattcctattccactaggaaagttacatatacattttcataacctacatatgggtatttagcataggtacaagttttattgtcaaattgagaaatgcagatcataccgtcttccccctgctatatttttacgctgtaaaggcagagattgcacagtatcaatcctataacatcatccatagtccacaaaaaaagagcatatgagatgccctttcagatgcaagcaattgtcttatatataatataaagaaagctcctgccgctgtcttcttgttacagcttcatcagaaatgcaatgcattcctcaatactgataaacacatgctctgccggctccacgattgcacttcttgcatgcatcatggcacagccgtgaaattcctcaatcatgggaatatcattaaaggagtctccgatggcatagatggcatcatgctccagaccaagatgctgttcgatgaaatacagtccctctgccttggaaacaccctccggcacgatatccacacagttcacattcacataggcaacagcatagcccttaaagttcgtattgatgtaatgactgatctcctccgcaagcatggtgtcgttcagggaaacaaccagctgggatatcttcccgcggtccaatacctcctcctcatgctcgtttgtatccggcatattgccgtatttatgatcaatctgattctcatccacggaaaatttaaaccggtggaagccgtcattgataacatacgatacacaatccagggttttgatatatgcgatgatatccagcgccttgttgaaatccatatacagcacctgcagacgttgaaaatcacggtcatagatcacaccgccgttatttgccacaatgaaatcaaattctatcttatttttttgaatctccgtctgtatggactccatacttcttcccgtaaccagaccgaacatgtttcccgctgcacgaaattcatgtatcgcatggacatcatttatatcaaccagctcctctgttcgaagagtcccatcataatcactagccagaattttcatacgcatatcctccatctacattcattttaccaagtttcaataaaaaaacaatgtttatgtataagattcataagcttttcccatactactatcaggaggtgttagaaatggcacagaagaaataccgcccaggaatgaactgcgaaaaaaccggcaaatacacatgctatgacaaagatggcaatgaaatgtacggtgacgtagacgttgaaaagggcagacgttttcctccttcacaggaagaaggatgctactacgaagaacagtagtatctgttcggctctgtagaacttatacaatggtataagaaaaaaaattcccattctctttatgagattgtgggaatttttttatgtcttcttctgctccgcatgaagggctgcttctgcatcggactgttttgcggacgtatcctttttcggcacatccaccagacggtagactgcccgtccgtttctgacacccagctgcagcaccttaatgatttcctgctcgccctctttcagcttcaccaggcaatatttatccttcaacagcttttccgccatgggtagggttacctctttttcaatcgactgaaaaaaacggtcctccttccacaaagcgaatttacagccgttgcgataattcacacagccaaagcccttgctgttttcaacaattttattcccacagacaggacagataccgaccgccttgcgatcatcgtcgatttccacctcaccggatacacgaagatgggagtaatcctttttcaaatgcggcacaaaggcttccagcacactgtccaccagggttttcacatcggcattgccttccttgatatcctcctgaatcacccaccattttgcggtcagatccggctttttgatctcctccggcagcaggtggtaaaagtcctttcccagctgagtagagataatgtttttccccttcatttccacataccggcgtttgatcagcgtctccacgatctgtgagcgggtcgcacttgttccgatcgatccgttctctccctttttatccttatccttcttcttcagaatatccttgatttccttatcctgtacatatttggcaatactggtcatatcccggatcagactggcttgggtatagcgcttcggcggattggtttccttttcctgtagttcactgcttaccagctgtatcggataggtgcccttcggcaaatcgaagcggctgtcatcctcttcctcctcctggctgtcctccttctccggcgtaaaatatttcttatagccctcatccagcacataggtactggtcgctcgcaaatccccatattccgttttgattatcgcactcagctgccgtttacgaatcggcggcagaaactgcatgatgtagtaccggcagatttcctcatacacccttcgctcatccggaagcagctgcgcgatattgaaatccgacatggttggaataatggcatgatgtgccgtcacatatttgtcgttaaagcattcggaatgcagcttgtaatccaccggatactgctcattcagcttgctcatgacatgcggcagcaccttgtcagcctcctgaaaatgctcttcctttaaatactgagagtcacttcgattataggtaatggcctgatagcggtcacgcagtgtctgggtaatctggtccgttttgctcagatcaaagccatatctggcattcatatgtgcctgcagcttcgcaaggttaaagggcagcggcggcttcacatccatgaatttctcatcgattttcaccttctgatccggcttggccatgatatcacgttccatatcctccatgatattgcgatgcagaatatgctttccatcatccagcagatcacttttcggcttcagctgaaagcggatggatgtatcgggctctgcgatatgtccaccggtatgcagctcataatatttctgcttcacatgatgatcaatggcctcatcacgcatgacgatcaatcccagcgttggactctgcacacgtcccacgctcatgccttttcttcgcaaaagcagggaaaacaggcgggaataattgattcccactacataatccgcaactgcacgggcataggcgcttctacccacagcacgcagtttttcatcattatcgatcagatcatgaaaggcctttttgatatttgccggcgtattgtcattgatatatacccgtttgaccggcttttcattttgtgcgtaatccagaatttcgtcaatcagaaactgtccctcatcatccgggtcacctgcatggatgatctggtcacactcctgcatcagtgccataatctgttccacacggtcctttttatttccatcgggaaccagcttccagttttcaaagcagatcggaagatcctcttttttccattttttatatttcccatcatactcatccggttcacacaggcgcagaaggtgtccgtatgcccaggtgataatgacattctgcttacgtatgacgccgcggacttccttaccgctgccgtcaatcgcagccgcaatcgctctacccagctccggcttttccgcaatgatcaaagaacgcatcgaattcctcctttgcacgatcctaaacaaatacatagaattatatcagaattctctgaaaatttctaatatttttcaaatcagggtgactggcaatgagacgataacctgtacataaaagataatctgtatatataataagaaaagcaagcaagctcatcagcaattcgtatggaaaagcagctgctatcagcaggatatctcctgtaatcagcgaacgtcatctccagtatgctacactccctgtatactttgacagcctatgaaagcttacagtgaggtcatcgatagtctgtactgacatctcctgtaacgaaaatcatatttttttctgtttataccttttaaaagaaactaaaaaaaaggcaccttgtgaagcgaatccctttcctttgactgttcaagctttggggttcatttcattgaggtgcttttcgttgcgttatgcctttgcagtaatcaaacgcgcattgataatgccttcccggctgcgcagtcgttccatcagttcttcactgacttcatcattggtatcaaggatcatatatgcataatcctttttccccttatttgccatattttcgatattcacaccgacattggcaagtgccgtggtaatggcaccgaccacattcggcacattcttattgataatgcagattctgtatttgcattcctgtgcaagctgcatatccggaagattcacagaatgggtaatatttcccgtttccagatactccatgatttcattggcagccataaccgcacagttttcttcactttccggagtggaggccccaaggtgaggaactccgatcacctgttcatattgcaacagctcctttgtcgggaaatccgttacataggctgcaatctttccttcatccatcgccttcatcatcgcctcatcatcgatcagaccgccgcgtgcaaaattcagcacacgcacatcgctcttcattgccgcaatcgcttccgcatcaatgatatttgcggttttatcactgaatggaacgtgtacggttatataatcgcattcctcaaaaatctgcttcagattctgtacatggtgcacccttgcctttaaggtccaggcggcttttacagagatgaacggatcatatccgaaaacctccatatccatggcggctgcggcattggcaaccagtacaccaatcgcaccaagtccgataacgcccagctttttacctgcaatttccggaccgacaaaattgcttttccctttttccacagccttggaaatatcgtcaccctccagagtcttgacccattcgatgccctttgtaatcttacgggaggacatcagcagtcctgccattaccagctccttcacggcattggcattggcccccggcgtattgaaaacgacaattccctgttcactacagcgatccagcggtatgttgtttacccctgctccggctctggctatgcatttcagatcggcaggaaattccacatcgtgcagcttcgcactacgcaccataatggcatcgtacgtgtcaaaatcctcagaaaattcatatgcactcggatcaaactgattgattccggcatccgcaattttattaaacagctttattttcatagttatctcccttatttatgttcctcttcaaattttttcataaatgcaatcagtgtctgcacaccctccagcggcatggcattgtagatagatgcacgcattccgccaactgcacggtgccccttcagattgctcataccggctgcggcactttccttggcaaacaacgcatccagctctgcattcggtgcacggaaggttacattcatcaaagagcgatcctccctgcgtacggtggttgtatagaaagcactgttatccagatagtcatacagcagcttcgccttttcttcatttcgcttctgcatgacctcgagtccgcccatttgttcaatccattccagcaccagccccaaaatataaattgcataggtcggcggtgtgttgtacatggaatccttgtcggcaaggggagcatagtccatcatcaccggtgtgaaatcctttgcatatccgatcaaatcttcacgaacgattgcgactgtcagaccggcacaccccatatttttctgtgctccggcaaaaatgatgccgaatttggatacatccaccggcttggacagaatgtcactggacatatcggcaacaatcggcacaccgttcgtttccggaacatatttccattcggtaccgtaaatcgtattgttcgcacacagatatacataatctgcatccttattcagctgcagctcctgctgtgcgggtatataggaataatccgcatccttgctggagcctgcaagaacgatttccccgtatttttttgcttccgcatacgccttatttgcaaaatatccggtcacgatataatctgccgtacccttctgcagcagattcaggggaaccatggaaaactgagaggttgctcctccctgcaggaacaaaaccttatagttatccggtatattcatgatggaacgcatacgttcctgtgtttttgtaattatcgcatcataggctttggatcgatgactcatttccataaccgacatgccactttcctcgtaattcagcatctgcgattgcgcttttttcaacacctccagtggcagcatggatggaccagctgaaaaattgtaaattctgttttcggccataatcaggcaccttcctttcctcttatacttcatccaacagcatgtttttctgttagtaagcactattatagcacaaatgaaataaaatgaaagctaaaatgaaaaaatgatgtaacatttatgaaagagttttctcaacgtaaacaaaacaagtacatctgtacacatattaaagacacctatttttctttcgctcttcttttattcgtggtatacttaccttacagaaattgggagatgagaacatgctggattttcgtttatatacattccttacgctgtctgaaacattaaattatacgaaggctgcggatatcttatgcattacacagcctgcggtttcgcagcatatcaaatatatggaaaaggaatatgactgcaaattgtttttttatgacggaaagcagttgaatctgacggctcagggtaagctgctggctgagaaagtgcgtaccatggttgcggatgagaaaatgatccgcagtctgctgaagcagaatcagaaaacacccgccctgcgctttggtgccacgctgacgattggagagtttatcctgccacagcgcttgaacagctttctcgctgagcatacggagacctctttgtgcatgattgtggaaaacacagcaacccttttacagatgctgaacagcggggatatcggcttcgcctttgttgagggatattttccaaagcagacctatgactggaagctgctgtcgcaggagcgctatgttgcggtaaaaggaaagcattataccttgcaaaaggaggtacgctgtttgaaggatctggtgcaggaaacactgattgttcgggaagatggcagtggtaccagagaaatactggagcgcggcatgcaggaaatcaatttatccattgcctcctttcagagggtgattgaaatcggcaatgtacaggctatcaaaacgctcgtcagaaacaatcagggaatcagctttctgtatgaagccgccgcaagagaagagatagaaaaaggagaactggaagtgatcgacctgtatgatttccatattctccatgaatttaattacattacactgaaggattcggtattcaaggaacaatatgacgccttctttgcatctgtgtgccggccatgatgattgtcatggctttttttatttgagtttttcatacttgctcagcaccctgacaccgtgcttcgttacctgacagaattttcataccgtgacggatatccagaagccaaaagatcagactgctctgtgtggtaaaactgcgtaaacaaagcgcggtataagaaatttccctgaagatctgcggcttataactgtaaaatgtgatgtgtctgtgtcccatttctaaagcacacacagctttcactgtttcacggaaaaagggtgtccctgtacagaatccatcaatacggaacacgcctttccttatcattacgtttttagtggttcaaagcatccttcaaagctatacaaacaccagctgtaccagcaccatataaagcagggttcccccgatgatactgatcatattattgcgtttccacacatgaagaagtacgacactcccgattcccagcagctccggcagaccgtacggatattgaaaaaaactcgtattgcgtacacagtagataatcagacagagcatgatcgccataggcagcacattccccagatatacaattttccgtgggagtgcttctgcgttcttgaatatcataaagggaagcgcacgtgtcagaaaggtgcaaactgccgcaactgcgataatcagcaggctatccgtaatacctatcatgatacatcctcctttttttccaccttgtcctgaaagatgacaagcagaatgaccagcagtatgagcgccggcagcagaaagttagataactgaaacagcgcagtggaaatgagaatcgcggctattgcgatatagacagcaccatgctgcttcgctgccagccactgctccacaaagatgacagtaaacaaagctgtcattgcaaaatcgattcccgtggtatcaaaggcgagcagagagccgatggttgcaccgagtacggaacctattatccaatacagctgatcaaataacgatatacagaacatcagctgtttcccctctctgctttccttattcggaattgcacacaataaggaataggtttcatctgtcagggaaaacatcatataccagcgtttctttcccatcgccggaaagctcttcagaaatgaaagaccataaaacagctgccttgcatttacggtaagtgcaaccagtgctacctccacaagtgaaaatccggcatgaaagaatgtcagtaaaacaaactgcatacttccggcatacacactcagactgatcaaaaacgcccagagcatggaatagccctgctgctggcagagaataccgaaagcgattcccaggaatacatagccgaccatcacaggaaagctgagccgcagtgcctcctttgctattttcatacaacatcacccctcaaaagttttcttatattttagacgatttctctttcgcttgcaatcccctattctttttacggatatatcataagcatgcagtctgcttatttacagttgtccgtcttgcagggaacacactgactggatggtagccaaactatcacgaatcgtataaagcatggaagctgtatgcttatgaatgcagattacatacctacctttgcatacacgttaccgctatggcttggaggacagctttaaagaggagatggaagaaggaatcataaaaggttttaagcagaaggtagagaggaagggaaaaagaggaatcaaaaaagcagagtggaaggctcatgttactttcgaagccgacagttggaaaccaagcttcatgatatccgcttaccgcggctgtataccttacagcagagcagattgaacaaatcttcagccttatgtttactgtcatacactggaggaaataaaaaattaaatcaaagcttcaaataatccataataactttatgtgaaaaactgcttttatttaatgatagagcatatagataaaaacaaaaaaaacaaagcttccttgcaagtaaaggatcgctttgactttcagggattccttggtaatcgatacgattccgtttatcattttatcaaaaaaatcaaaaaaagcattgacaaggctatctgctgcatgatatatttattaagcaatcgagatggggtgttagctcagctgggagagcacctgctttgcacgcagggggtcatcggttcgatcccgatacgctccaccatgatagatcagaagagattcctaacggaatctttttttgtgctttgtttaaatggtataaaaaaataagccgattccacatccttcaacaggagaaaatacgggaatacggcttttttatttcatcttatatatacgattttgcgtacaggcatcaaacagaagtacatattcccagtcaatccagaaccggatattctccatgcgctgatggatatgggaagtatctgacttcataataacgactccctcttcatattggatatgataatacacctgctcaccggactgttcaaccaatacaatgctgccgcatataccaccagttgatacctcaatgacatgttcacaacgcaccgccagtattacggaaagatttttatcatctgacagccatggtatcttctgctcatgaaagaaaagctccccttgtgcaaggactgctgtaaactgattgatatcatatacacctaaaaaagaggcagtaaacagattgattggattttgataaatggcaatcggatttcccatttgctgaatctctccatccttcataataatcagaatatccgccagtgtcattgcttccatttgatcatgtgttacatagagaaaggtggcactgtttttctgatacagctgcgcaatttcaattcgaagctgtgtcttaagtctcgcatccagagaactcagaggctcatccatcagaaacaacgatggttttcttatgagtgcacgggcaatcgcacaacgctgtttttgcccacctgataaatcacgcgctttgcgttccagtaagtcacagatacccagcacttcacatatctgatagacagcttcctttatatcctgctgcttcattccgctgtgagcaagaccgaaggttatgttctccaaaacactcatatgaggaaacaatgcagcttcctgaaataccatggagatacttctctgagcaggtgttttctgattgacaagctgatcatcaatatatatttctcctgaatccggagtcagaaatcctgcgacaagctgaagcaatgtcgttttcccacacccggatggacctgcaagcacaataaagcttttttccgagagctcgagatgaaaatcgcgtactgccttaatatccccataggattttgttatatttttcaataagagtttactcatgcacatctctccatattccacattaagtgtagccgaagaaaacaaaaaaagcaaccttgtcgagcaaagctgctgttcttgtaatcccccattcgtattgattttgtaaacagtatcagtttatttactaagagtgtacatgagaataaacgggcttggggaagaccattttcacaatctccatcaatacgattcccatatgatcaccgaagtgatccccagtgtctcgaagcccaccctcttcaagacacctatatgttactagaaatagtgaatttatacaatggatttcatgtaagttgacatttaataaaaattttggcgattatcacagtttttcaagaaaatcgtcaactcgggctgtaaaagaaaaaacttcttatgaaaagaagtagttttcttatactctcacatttacatttccgcctgaaccggcaactttaggatttggttttgtatcaagtgcgaaaaaacatgaacaaactaaactcaaaccacaaataccagctattaaaaatttcttcattttataacctacagttaaatcatttgatcatatgcatatcatctaggacatgcatatgatcaacgaattaagagaaggtttcaataaaatagaattgagttaattgaaaacaaaaaatattgtgataaaacagtttttttaacaaaagcatcaacttacatttgctttattttctctaattcttacatcaaatatatgtaattgcttatattgatttgtaacctctattaatttcgttacttcaaatctaaaaatatctattatttcatcatcatataaatatggtaacacttttttgaatatataattttgttttacaaaagcaggtacagtagatggaagtgtaaaatacttatacatcactcttaagtttatgggggattttcgaagattagaatcgctaagtttcggaatatcaattttcttatctaatctattctgacaatctgccatataaatataattaacgatgaaaaattcgtcataataatccagcatcaattgataatgataaatagccttctcataatccttcattagataatacgctgttccaagatttgaatgagtttctcctactttaacatcaggataatcatacatttttaataagtcattaattttttgtatgtaaatgagttctgcttttctatcaatgtctgaaagtaaaataattacatagttatatgtatctaataagcgaatattatttctttcattaatgaaaatagtttctaattcttctattagattcaacatatgaacatattgactactgacataaaaatagtgtaaaaggttaactttcataaagtgatgttcacatttttgcagttctaaatcatcaacaagctttttatatgtgactttatcacacacagattcgtttttcattttactgaaaacaagcactttaattaaatctgaaaataaatgtcctaatacaggcagcatcattatcaaacgattagctgtcttataatcaatatattcatcatttacataataattccttactgattcaattaaaactgctatttcagaataaaatacaaaatcagtaaccttgttaagaatattaattattttgatggttaaaacatcaattaattcactatcataatactctattgcatcatataaatttgatatcacttttctcaaagcctcatctataacaggaaactcaccaaatttcaaatccagcttatccaacaattcaatataaacatcctcggatctgctcagtccgccagcctctatactctttaatgtatttatactgcaaataccatcacaaaatttcttcagagtaaaactattttgtgtattcatccgccgttcttctctgtaaatgccaatcagtttaccgataactgataatctatctctactaacattcatatatatccctgcctttaacttcactctctagtaatgctactcatatattatagaggtaatttccaatatttggaagttaaaatcacataaatgtcacattcttacttctttactatagcttttcacagattatcgtcaaaaagatagtaaatcgatgatcattaaaggttagctaatgcctcttatcgcttctgtaatgtatgcagaaaaagagctgtgatgaaacagccctttaaaatattgtgggtatagctttttaggatagttgtagagattgcaaaatcgcaggtcgaatatcatcttcaacatccagcatattcatagcatcgaccgcactgacgttgatactttgcatcagtttttttacatggagtagtgttgcttccactttgccttccgcttttccctgtaataagccttttttcagtccttgctccaaacccttttcaatccctctttgttcaatgaaatcgctaaagttgcacatatccataacctcctgatctatctccttctccattagtataccatacgtcttctgtaattgttcctttttatcctctataacgagattttttataaacaaaatctttaacagctccagcagtctctgcttgttctcatcctgctgctctaccgcattcggaatatcttgcgcttttcgtatgccttccttcttcggatacaccatgactgctgtgagcaaatcatagtcctcctttgcggcatgccatatctttgtttcacatgtttcctgtatcctataggtgttaatgacatcattcttttgattgttatgtccgatacagatccagatggaacagacctttttgatcctgtcataatccgaatgctgaaatccgttctttggatgcttctgctttgccatcaatctactgcaataatacaaagcacgcttgatcagaggataacctggatcatcctttgcctggctttccagattgatgatcatgcgaactttcttatccgcaggtgtgctcttatcggcttccttctgcttcatggggattgtcgcctcgaactgaatatcgtatttgatctgtgcccccggtatagcttcatccgtgacctcaacctgatgatcatcgatatattcacagtctgctgtgtttatggaagacatttcgatataggacggtatgtcctccaatggagtatctgcgtattccggaacacagcccttcatcacataggcgagaatctgcttgtttgataatagctttttacagtacatgtcatatttctttttatgatcatagcagctaatcatagatgctgcttctgttttcatttttgttgtcataatcatatcctttctttctcctattgctatctgtacttcaaggatatgatctggtggtgctcttgttctgctgttgtttttattagcaaatagaagtatctgctgtttcgtatcatacgcaggaacggatgcaacaaaaacaaggcagtcattaccgccgacaagcggtgttcagctgctgtaagctacttaataattgtaaagaaggaatgaaagcataagaaaaaacgcttctagcaagcggttgagctaccgaaaggccggggcttttgcggatgaataccatgtgaatgcaatgtattatttatatagtttctcatagaccgacctctcctttttttgtatttacagtgtagcataaatcctgtcggaaatacagaaaattctataaaatctctacgtcataaaagaagtgaaaagctagttttctgcctctctgtaaaaaaagcacccacctggatgccaatatacgttcgcagtcttgttttaaccattcgcttcattttttaccagaaagatatgcaaatactccatcggctgtacaaccttggaaatgatacggtatatataaccggcttcctccagactgccttccaggggaagcccctgtgttacaactgcattcatgcttctgtatgtcaatatatcatatagaaagctgttcttttccttcagtagcgaaatcatctgctttgcctgttcaaaatcctcctccttcataagataaagaaatcgaataaaacagcaaaacgcatcattccttcgatatttatcaagcagctctctgcaggactccagctcctcaaaatacaacgcaatgctcatgagatagtgccgcacctgaaacagatcctcgggattcagatttaaaatctcctgaaactgtctttgcgccttcctcatatatccggcctcgtacaaagatgccgcataagcgaacttgatatgaaacaacggctttgcttcatcaaattcaaaaaaatcagatgcatcccgcagaaaaaaatcctttcccagattcatagttgccagctccatgccctctttcagcataccgagctttctgtacatattctgttcattgattcccagcactaggtaagcctcgatacagtctgtgcaaatccccagcgcttctcttgcaatcgtctgtttcttttgcgagctgcggcagtgattggcttcctccagctttttcagtgcgtcgcgatacgtattctgatttgtatcctttaccggatgtgtttcatccagaaaggcatccagtgtcatctggaaggtaatgccgatatctgttgtatctgaaatatgattcatatagagtccctcatcatttcccttattatatgccagttccctatattactcaatgactttcgttcgactgtttcagataatctactgcccagtaactgtcaatttcctcaaactgattcttttgcggcggcaatttcgaacagattgcatcataggatgtcttccatattccaatcacatcctcttcttcatcatgctgtacatgaaaccagatcgtatctgtctcctgatcctgatagacaacattcttcggcagccttccctttttcttctcccgcagaatgatttttaatttcagaagctccatcgcccgatcatccagcttatcctccagcattctgattttctctgcgacctgcgacggatcgcaaaggtagcggcggatacaatttttttcagactgaaaaatagaaaagtccttatctgtcaaatcactttttggcttaaccagcaacacaaagcgatgctttttatcaacatatatcatcgtatggagaaaggtattgatttttccacagcttgggcaggcttttttaaagaataccccctccagcagctccttccgaaactgcggctccatctccggcatgatcaaggtttcactctttttatgtgttttgtaaaagcagcggggacaggtaagctccaccaatatagatttcataatatcaccatatgtaacattatacctgtaagcgggcatattgcaataacaaaacacaggaaggatgattgttccattctataatagcgccagcaatacgatatcagtgctcctgttccgctaccacatccaaaaagcttcctgacatcaaaaagacagagcgaccgccctgtcctgtttattaaatttctctggttgcgtatttcagccattccttttccgcttcattcagataaggagaaaccttgtcatacacctctttgtgatatgcattcagccacgcaatatcatagcgcgtcatcagatcaacatctagcccgtccagatcaaatggtacgaatgtgatcgtttcaaaatacatgaactgtccatattcgtttttctcacctctgcgtaccaccagctcattttcatgccggataccatgggagccttccacataaacaccgggctcattggactgggtcatcccctcctccagaacacagctgtcatttctttccggtaccactttccagcggaagccgtttggcccctcgtgtacattcatcagatgaccaacaccgtgccctgttccgcatttataatcaattcccatttcccataacggacctcttgcgagaatatccagattcataccgcggcagccttcaagaaattttgccctgctcagctgaatcatgccacgcagtgcacatgtatagtgtgtacggatttcatcggagatcggtccgaggacaaaggttctggtgatatctgttgtgccctccagatactgtcctccactgtcaaccagcagcatcccctccggcttcagctcgacattggtttcctcactggcactgtaatgcatcattgcggcatgctccttgtatgcggaaattgtagaaaagctcaaccccagattgtgttcctgttttcgacgcagactttccagataatcactggcactgatttccgtaattgtttccttgccgatgttattctttagccagtacatgaatttcgtcatggcaacagcatccttgatatgcgccttgcgattattctccagctcgatttcattttttcttgccttcatcagctgagaaggattcggacagtctatgatgcgaatctccttcttcagattctgtgtgattgcatagtttacaacacctgtattcagcataacgcacgcatctgccggaatggttttcacaaacgcataaatatcatcatatgcatgtaccgctacagcattttccctgaagttcgcaagcatctgctcatccagcttattctcatcaataaagatatgattttcattgtgggtgattaccagataacacagcatgacagggaaacagctgatatcccagccgcgcatattcatcatccatgcgatatcatccagagaggttacgatgtgatgtgttgcgttttgttcctgcattactgtacggatatccgccagcttatcctttgtgctttttccactgtatgcctcttccagaaagaagccttttttcgtaggcagcggcggacggtccttccagatcataccgacaaggtcttcctgtgcggaaatagtaacatccttgtccttcagctcctccataatgtcatgtacaagtctggtgttcatgacacgtccgtcaaagccaaacacaccgttttccctcatatgctcacggatatatgcaggaatctcaggcacgccttcctctccctgcttcatcaaatcaatcgtgctgtccttcagctgatttgccgcctgaatgaaataccttccatctgtccatagggcagcacagtccctgcatacgatcagtgttcctgccgaaccggtaaagccggacataaagcttctcgccttaaaatgctctccgacatattccgtttcatgaaaatcggatgttggaatcatgtatacgtccatatttctttcattcatcaatgttcttaattgtttcagtttctctattaccgtcataagttcctccttcaatcatcactagtaaccattgtactccaaaagaaggaaattgaatatagatttcacctgaaaaattatggtttgtttctctgttatcgtatggtacgcattaaaagtttgcctgttccagctgtgcagtgagctggatcatgatttccctgtcattcagcctgtcagcatctccctgcatgatgataacgatgggatgtgcccccttcagctgcatgccggtgtcgtatattttcgtatccagtgtgtcactgacatcctgtttggtttgtgtatcatatgccgttaccttcatatccagatatgtattttcaagattggcagtatcaccctccacatgaacacaggttgtgcccttgtaggtcagaatgctgtttagcttctgcttcatttccatatgcaaggcatcggttgtgacccgtatcccctctttcagcgcgatactgttctcccataagcgaaacattgaaaacgtaatcaacagcacagacagcgcagtcgcgattcttatatataccatatctcttttcatagccatatcctcccaaaaaaaaccagtcatttagagtatgaccggtttcttattttttatagctcaggatatgaattttgtagtatctagcatcctttacatcataaatagtatagttgaattgctgatgagttcctgcaggaatgctgtcctttccggttaagaaccatttatcagtttttatcaggttcctttgttcatcatacagctgaatttccgcttttacaaaacgcactgcaaatttggtatcattatgcagctccccattcaaaacgcaatgtccctccaactcctcaaattccactgcatccacatagagtgttttctgttttttcagtacctgctctttctctgcccatcttgtgcgtatggtcttattgaacagccagattacggcaagctctgcatataacaaaataccgaatttgcttttcagaaagagaaagattttaccgataaaggggatatgaaacacataggttccaacaatatccttgcgcagtgtcttatacatgtccaggttatccttaccctctgcattggtgcggtatatggtatttccctggaaatctttttctgttttattaaaatgatgtgttaatagaatatcgtcaccaaagcggtctgctttaaaggtaatgatatcaccttttttcaaatgcagtggttcttcaggatcaagtaccttcgtacacacaagcgagaaggtgggaatacggggctccatactgtccgttagtacagcatataggcgatagcctgtaatctgtgctgtttcctccggatattttgccataagaaaagtataggctgccagtaataacacaacaaccacaaacacaatatttgcaatgcgcttgattacgtttctcatatgcgatcctactttcctcatcttctatattttataagatttttggaggggtgaaaagatttttttaaaaaagccgtcgaatgacggctgattctaatattctaagctgcgctgttatcaggagttaattccgcaacaactaagatgtaagcagttgttgcagtaccagctgtattttcagtatcatttgtagtagttgcagtaattgtcggtgttatcttgccattggtggcctcagaaagctttttctccgaatctgtaactgtggtagtaaccgatgataagtatcccgtagaagtagacggatctgaaactttagctgcatcattagcatgtgcaactgtatcaaaagcatatgccgaaaccttgatattataagcagttggatcaacactatctggtatgttctttacttctattgtaggtgttgatgtgaactttggatcttctcctattactgcatttgtttcagtaaaattcgctgcagtaactgttgtcgtaactcctgcacggaaattcaacacctctgatgttgcagtaccttttgtctgatcccatgcagcgaatgttcctgcggatgtagcgataacagcacctgctgttaataacgataatagtgtactctttttcatataattgttctccttttcaatggttttaagaataggtaatattttttgttaccttttacactattattgtaatccttttgggaaactttgtataataccaataacccgcaagccggttatgcattttaggtatagctacatatctgcataggtttcatgaataatattaagaaacacctttcctgcttcgctcagcacttcgcgctttcttcggatgataacaaaatacttttgaatatcacagtttctgatgcgcatgctgtggatatgtgaatgctttaattcctcaatctgccatttattccccagcataaaggcatccgtatgattcagcatgttgataatcgcatggtagttgctcattgtgatcgttttcttaaagctgctcagctgcacaccatccattgtcaacgacatattcagattcgagaaaaaatcatatggcagatgaatcagtgtgaaatccagaaaatcccttgcctccttctcctccaccagctcatccagattcttctcgttgatatgaacgtacagcggtccttttccaagaatattcaattcaatttccttggcatccgccatcttacgataaatactcaattgataatcatttagaatcatgattccgatttccgacttcatttcactgacattggccaacacctgctccgccgttgtttctaccatatgaatctctgtagttgctgatttcatatgcttgtaaaattgtaaaatcaaatcatcccgtaggaatacagaatccacggataccgtcagcttgctatacagcttttcctcactgacatcctttaaacgctccagcacctgaaactgcgagaggattgactgtgcataatagtacatcagtctaccggtcggtgtcagcgtaactccgttattgctgcggataattagctctttccccatttcttcctctaatgactgtatacttctgctcagacttggctggctgacaaacagcttctccgaagccttgttgatgcttccactgtcgaccacttcaacgaagtagcgtaattgttggtttttcatctctcattctccctaattgtggacatttatgctcattattatgataacataaaagacagatttctacgtatgcagattctgcctttttctgtaaaattattgttttgtattcataatataggaaccattcgctgttgcgaccaccttgccgcttttctttgagcgtgcaatagctctggtctgtgacattctgcttcctgcatgatcacaaattccttccaccagcagcgtatcgccactgctcacaccgccaacatagttaacagccatttgtatcgttggtgtaaacactgcattcccgctcacatacgatatacatcccatcgtaatatccagtgctgtcgcaatgatgcctccatgcagattttccgccggattcatttgccagtctttcaccggaaaagccagaaccacactttttgtatgaaaatccgcggttaccagctccatatccatcatggaatttatcgtaccttcatcgcgtactctctgctttacaaaatactgaatacgttcatggaactgttttttatccatatatatcacatccttacctgcctattatactccttacaggaaagaattcacacagtttgcacaatgaaatcatttctgcttccagttcaatatccggattttgtaatcataaacaccatatacttcataagctgtataggaaaattctcttgtttcttccggctgtaaaaaatctctgccgcaaagataccatttcattgtctttatcacattacggaaatcatcatacaattcaatttccgctttaatataccgtacaggaacaggtgttttattgattactctgccggttaatacagcaaatctgctgctgcaatcaaattccatatcttttaaaaggattccctgttcttcctgcgtttccacaattggtgcttcttccacctttggtttttctatttcctcaggttcaggcatttcctcctgctcatccgtctgcctgctcttgttgatatcatattttctgttgaagtccggatattcctgttgttctgcttctacccgctgtggtgctttcacaccgtgcagcagctcctgcacctcttttcggacttcctccagcagttccttatctacaccggcatccgctgtgtaaatgtcatttgctgttacctgttcttcttcatgaggttccttctctgcaatttcatcatttttcaccattacttcgtctggatcgctggatggatcttctgtttccaccggattttcttcttccacaggacattgtccgccttgcagtgtttcctgtatactggttactaccggttccagaatgccgattgcctgaatatgcagttgattggcatttggtattttcttttcgaattttgtcgcaccggagttatacagtccctctatatccttttgcgtatccttcggataccgtacaacctgtggaacgacatgatgcggtgtatcgattaccggatgctcatttagttggtactgctcttttttttctttgacagcttacgcaggacttgccgtagcggtatcctgatccgattcctcttcgtttgtattgattgcaatcagtatatcctgtagctcagcctgtgtaaatgtagctcccccctctcgcagatcaatcgtttgttctggctttgattttccagaggatgtatgctgaaccagagactcctgcgtaatctctgatttctgtacatgcttcccctgtgcatccgggtgctcctggatttcctgctggattttcgttgggcctgccggcttctgatgcttctgcttgtacacaatcggcagcagctcctcatcatcagccgctttcctttgttccaccggtgctgttttcagtgcatggcgcttgcgtaagcgctgctttccggtctgtttcggaatctgctgttttgaagccgtgcctgcttcttgtaaaatactgtcggtagctgcctgctgtttggctttcgcagtcttatcttctgttccctttgcctgtcttgaaatatcttcctttggagtctttagcagcggcttctctgcatctggcttcacttcctgcccgcgcgtatcctctttcttttcatccacgaagcgttgatcaggatccaaagcattctttttcgcagatacctctatacccgcttttccttttcgctcccgcagcacaccctttatcaacagcagcatggtgctcagtatacaaacgcccagcaccacggcatacgtgatttttccatagctgctttgcagaaattcatacaccctgcccatatacttcatatgaaagagataggagcctaccagatcctcatgtctggtttcataggtatcataatagctgctgtcaggggcctgtgtaatgtaaaaggtttcctgatttcgaacttcacttttcacaaacatatgcgttaagataaccaattccccaaaccgctctgcccgaaagctgatcagcgtgttattttttggttcctcgttatctttgaaggtctttacaaagatgagagaatcctgttcgatcgctttttccttgtttttaccggtaacctgtatcatccggatatgcagaagatgctcgctctgttttggaacataaatcagaatcgttaccaacagtaaaagtattagaaaaaagccttccagaatccatgacagtttttgcttcatatcgtatccactcctgcttgcactgctgtattgtctaccgttattctatcatagattccagcttataaaacgcccagaaagtccttatttataaggtttttacaatttctttccgcaaatctcagcgtaaacataactttgtgtttttatcttaagatttacaaaaaaaagcctccgacaagcagtcgcaaggcagccttaagcagcattgtgctcagactcaaaaatatcttcatccagaaataccatacgcggttcatggcagctttgcaatacatccggaatccccattaaatccacaccgcagaaatgggatgcagcatgcagtgcggcgtttcctgtgaggggtacatacagataggctataccgcagcagtaagcggatgctataaagcctcccagctcttttagttgctgattccctataatcagcaggctgctttccttttgacatccgctttgatacaggaatcggacgattgcctccagattatcaaaggtcttgatatgtgctgtaccgggaacagtatagcatgcagcttcaggaaattgcgctgtgatgtccttttttatttccgccggtacatcggattcacaaagaatcaaaagcttatccgctttgatataggcgttaagttgttttacgattccccggcagtgatatacctgctgtttttctgtttgcatcctgcttcacctgttctttctcttttcattgatcagctttgggaaataaccgctgatacgcacatgatcgaagaagatcacaaaggcctgttcatcacagccctgcacctgtttttttaaatgaccgtattgtcctctcgtaattgccaccatcatgacctccttcctgcgtccgctgtagccgcctgttccatcccagacagtaacaccacgccccacatccaggatcagctgctgcttcagttcatgattttccgtgataatcaaagcagccgattctgcattatcctcgtgaatgcgatccagcacgaaggacaggatacagctgtgtacgatggaatataaggctacctgactgtcgtaaatgagaaaacagagtagataaatcaccgtattgaccagcagatagatactgccgacacttccttttcctgtttttgtcagatacagtccgatgatgtcaatacctccgccgctcccgcgccccttgaagaacagccgtgtaccatatgcacatagaaaggagccaagcaggacagagataaagacatcctcaaccagaggcgctttgggcaccggaatcaaagacaaaaacaaagattcaaacagtatgacgattgccgtatgcacggcaaatgttttcgccagcaccctggcagcgagaatgatcatgaagatattcaggatcagatttataatcccggcgatatcaaaggaaagtcgatagggcaggatatggagcagcaggtccctgagcagctgggcgattcctaaaaacccggcactgtagatatgcagcggaaccagaaacacattcatcgagaaggaaaacagcaaagctccgctgatacagtacagccagtcctgtgctgtcttcatacgatatagcgctgtacgcgatcactcattcccaccgcgatttctcctgccgtcccctgtatgatttggccaagcagatagctgctgactgccccggttccatcatcaccactcaaaagcgcatattccccgacctgcactgcttctatatcggtcacatccaccataaacatatccatgcatacctttccaatcaaaggtgccggcctgccatgtatggaaacatagctctgcggggactgtgcgatacagcgtcggtagccatccgcaaagcctgccgccagcactgcgattctgacaggctgttttgcgataaatgcatgaccatagcccaccccttctcccgctgcaatatcccgcagcaggacgattctcgctttccagacaagcacctcccgcaatggtatcaagcgctgctccggggctgaggcaagaccaaagatataggcaccgacacgcaccatgtccatatgcatatctggagcatgtatcgctgccttactgttgcatatatgacagatgcccgtatcgattcttcgttcctgcaacgcccggatgcagctttgaaagcgctgatactgcaattcggtaaacgccagctccctttgattgctgccggcaccgtataccagatgggtatacatccctgttatttctatattcggaagcgaaaacagagaaagcagctgctccacgcagtctgctgtagaactacagcagtcgattcccatgcggtgaaagccggtatccagcttcaaatgcacggcagccttcaggttcatgcctgcacagcactcggaaatatgggaaagaaacgttgcggaaaaggcactaagtgtgatgttgttttccgcagccagacgtatttcctcatccgatacatagccaaaaacaagaatcggcttttctcctgatacgcttcgcacacgcaacgcctcctgcatggtggctgttccataccagtcgcataaatcgtccatcgcctgtacacacggctcgattccatgaccgtacgcattcccttttacgactgccataaatctcgttcctgctgtgagatgccgcttcagctgcatcacgttttcccgaattcgcgctgtatggatttctgcataggttcggcagctgatgttttcttccatacctattcggctttgccgcactccgcaatgatggcggcttcatatgctttttgcagctgcttcaaaatcggtcccggctttccatccctgatcgtatgcccgtccacctttaaaactgcactgcattccgtattcgtatcagcgacaatgacctcatctgcggcatacagctcatccagtgtaaaattgccttcacgaaatggtatctgttcctgctcacacagtgcttccagtattttcttcgtcgtgctgggcagaatatcctcattttcaacatgtgtcagtatacagccgtcctgaacaatcaggattgagccggatttttcttccgtgacaataccgtcctttaccagaatcgccttccctgccccttttctctttgcctcagagcgcgccatgcagtttggaatcagattcagtgtttttacatgacagtatttccagcggatatcctccacactgatcgcagttgttcccgcctggattttctccacattgcggggagcatgtaccgcaaagccggacagcaccggcctttgatcctcacgcccgggatacagatggtttcggatgccgtcatcccctcttgtcagctgcatatacacataaccgctgtgcagatcattctcctcaaccagctgctgaaagaagccttcgaattcctcccttgtatactgcagattgaaatcaatgacatccgccccctgaaacagacggtcgagatgccgctttagaccaaacagcttcccattgtatacacggacgacctcatacagaccgtctccgaagacatagccgcggtcctgcagagaaatgtggatatcctgctctttgaccatagctcccttccataaatatcgttccccgattccttttttttctattccattcatccttatatccttctttctattccttgcatgccgaatagcttattttcccgctcagcatcccgtatgtttctttgaacacctcatccatgtgctccttcagctcatcaaaattcatgaatttacgggaggtcacagcttccagaaaaatcggaaggttgataccgtaaaagcattccagctttttctctttatacagtctgccgattgcctttgctgtgacattgcagggggagcctcccagtaaatctgtcaaaacgatcacaccgtccccttcatccgcctgttcgattgccttgtataccttctgttcaaactgttcaatgctgtctccgtgaaacagtcccagatgtgcaacattcccgatatttccgacaatcagctttccgctgctgacaaaggcttctgccaggggtccatgtgtggcgagtaccagtcctatcatacgacgtgtcctcccctaggctgcgtctttgatttcgattcgcttatcatccggtacgactcgaatatagacgtccatgcccttgctctgcatagccttgatgctattcatttcttcctcattcaccgcaatgttgcgatacagctttcgtctgtctgcccgggcaccgattcctccgattcccactccctgtatcggaacacccgcatcatgcagatccgcgaaaaccatcggtgttttcgcaagcaggaagattcgttcatcctcactgcctgcttccttgagataggagatggcactgcttacggaaagcacctccagctccagactgctcggcattgcggatttcatgatcattttcataaaggaatcctttgcggccttatcatccacaataatcaccttgcttgctttggtatgcaagacccaggccgtcatgacctgcccgtgtaccagccggtcatcaacgcgtgcatatacaatatttttcatacaattattcctcttccttctgcagacaggcgataaatgcctctgcgcggtgctgcaattcctcaaagcggccttcctgaatcacacgcttatccatcaagcgtccgctgataccatagccggtgcagccgacagccgcaaattctgcgatattttcctcggtgattcccgcagtcgcaatgaatttcacatgggaaataggtcccatcagatccttaatgtaagaggctgtcattctggcagccggaaacagcttaacataatccgccccgtattcatgtgcatccagtacctcgctggggctcagtgctcccggaatggacagcatgcccagctcctttgttttacgaatgaccgcttcattgacattcggtgaaatgatataggcagcctttgcctgataggcaagctccacctgtgcaggactgacaaccgtccctgccccgatcgccatacggcctcgaaaatgctcctccagcatggtgattgcatccagtgtttccttataatccctgcttttctgatcaaaggtgacctccgccagacggatgccgcccttatacagtgcttccatcgtcttgaggagggtgtcaccatagacacccctgcaaatcacgataagcttatgctcctccagcatggctcgaattgtatccatataaactcctttcttcgttcattttagaagaatccaatcagcacaccgacaatagcgatggcaatcagaatcagtatgatcttagatgttgaaagctttttctgcagcaggaagtaagagagaaagacaaagccaaccggcagtaagcccttgaatatcgcatcgaagatggtttcctgcaggaccatgtccgagcttcccagatgcagcaccgtggaagaagtgaccgttaccgtcgtggcctcaagccctcccagggtaatggctccaactgccatagccagcgtcataaagcgctccagctttccgctcgcaaacagaccgttgacagcttcctttccctttttataggaggtctggaacatccagtagcagggcaccatgacatagagaacggtaacgatcatatagaagatcggaccgaagaagttgccgtccattcccataccaatcgcaatggaggcaacgatagggattgccgttccctggcgcagagcatcaaatacacctgccagcggtcccatcagtccggttttgattgcactgatgtcctcgccttcaatcggcagcccgttcgcacgctcctcctcaagggagcataccagccccatgatgatggagccgccgtaatacccggctgtattaaagaattccatgtgccgctgacatgcattcacaaattcttccttatcatcgccatacagccgcttcagcaccggtcccagacagcccagcacaccgggcgtctgcagacgctcgtagctcagcgttgcttctccaagcagatgccagagaagaaagcatttatttaaatcggtctttgtcagctttttctcagtctgtacgttggtatctgttatctgacgttccatactctacacctcttcctttgctcggttgaatttgagatcagcatacagggatgcaataatgaaggctacaactgcgatgacaatcattggcacattgccgtagatagaaagcacgaagcccagcataaacagctgaataatattcggacggttggacagcagccgcaggatgatcgcaatacccatcgccggcagtatctgtccgattacggtaagaatctgcatcggcgttccctttaaggcgtccagcacctgtgtagcgacatctgttccgaaatacaggattccgaagaccggtaccgcagagatacagaaggttgcaatctgtgcaagtacgaattgtacaaagtaaatctttttcatatccccctgtgcggcggcactgtccaccatgtgtacgaatacggagttgatggtgcttcgcagattccatacgatggtcccgacaagaccaaaggatacggcaatcgtaactgcgacctccggagtggctccggttgctatcgccagagatgttccgacaacccctgcaatgccgggatcgcttggaattgcacctccgacattcagaaacccaagaactacggtattgatcgtcgcaccgatgatcagaccattttgcggatcccccagaatcagaccgacgatggtgccggatacgagcggctggcgaatggatacgtgtacgattcctgtaagccagggtggtgagcacagcgtcatataatacaaaattctgataagcgctgcctgtaaaaagttaatttccatgttttttctcctctcatgttgtttgaaaacctagtagctactgactgtttacacacatactataatcgctcaaaaacctcccgtcaaataacgcaaaagcacagttttttttacattcgtgtcacttaaaagatagaaaaagacggtgatattttccaatatatgcaaattatttcaatatccgcatatgtgtgcttttattacccgcacaaactatatccgtgctataataagtgtgcaagcagacggcatgcgtgcattctgcagcccggaaattcagcaccaaaaagtggaggaagtgtgaaagaaaatcaaatttatgaaaagacaagtagcttgaaacgtctttcatgcaatgcctgtgtccgcgtgcaaaacgcggggagtggaggaaactatgaaaaaagcacctcgaatgaaggatattcaaaacctgattgccagctatacggcaaacggcattacagcacacacctatgatttcagcagctgtaatgcgcatgacatcgcattgattctgaaaattgatcgaaccaatgtatcccgcgttctcaatcagctgcatcgtgaaaaccggctcatcaagctgcagggacgccctaccctgtatctcgacgccggtgtcattcactcattttctacagagccggttccgtatacactgccggtgggaagagatattcaggaatacctgcatcaggataagcctgtgcgcgtgcgggagcacagcagcaggcaaacgctcacctacaccggtattcatgcgaacgaatctctgcattctctgtatcaggagctgttggcgattctcatgtatccccaagcccttcaaagcttggcgctttgtgccccctatggagaaggcaagcatcattttctgaaattttttatagaaaaggcgaaggagctgcagctgcttggcaggcatacacaaatactggagcatgtgctaagcgatgcggcagatgaacagaatcagatttataacatgcatccggagacccccgccttcctcattctggatgtacaatgcagtgatatgcacattgtacagcaggtggcagaaaagctgcagaagcagcatgccgccttacacagcagctggaaagtatgttacctgtttcatgatgcaaatgcggatatcgcacagctgcagcggtttatagactatccgatggtgtttcccagctatgagatgcgtacgctgaaggaacgtctggaaatcatattcgccgaaatacagcggcagtccgatattctgaatcaaaccatctgtctgcataaaaatgtaatcacctgtatggcacttgcagacaaagcatataccacacacatttccctgcaggagctgcgccgttccatcatacgggcacattacagctttattcagcgcaaggccaatgtcatcgatatcacctttgagcatctgtccgatggtatgctgaacagcattcgggatgtatcctcccgctttgcacagctgcacagtatcctcgatctgtttgacggtgatgtgctttatttcataccgcagacctcctgccgcttctttaccgcactgcatcatgccgtcctgaatgagcagcatctgattgacagcaacgatgatgagcagatcgtttccatctgtaattccatgctgaaaaagacagagaaaatagagatcaatacaattcgctccatctttgtgaaagagctttacgatctgatgttcccgctgctggcatccaccccgctcaagcagaaggagacgatgatcttcgttttatttgaatatctgcaaaatctcataacggaattaaagaataacacctatacccgcagctttacaccgtcacacggtcttgggacaaagcgcacggatgctgttacggaggatatcgcacagatcattcaatccaagatggaggttgtactgccgcaggatgagcgcattctaatcagcacctacctgcagctggccattcaaaagctggaggccaaaactccgatactgtttgtatgccacggggaggatatcgccgcaaattatgaaaaatacatacgctcagccaatctttatgaaaactgtcattcgctcgattattccgaagcttggcgaagaaaggaatttcacctcttcctcgatcacgtatgcgacaggatccagcagatcgataatcatgagaccctgctgctgtttagcgatatcgctccgttaacagagattggcgaacagatcagcagccgactgcatatcgatgtacaaagctatgcccctatctcgcttccgctcattctcaataccatatccgcaatgaagcacggacatgcacaggaatactacagccagccgcagacaccaagctttcctgcttcctctctcagtgagaattcccgaacactgattgaccgtatttcccgtcagatactccagcagtccctggtctttctggatgcgaacaaggcttcctcctctttgatggttgtcctgttaaatattttgaaaaagctgaagctcggttatagtgatgaaattaccatccgttttatcatacacggtgcattcgtcatcgagcgtgccatccgcagcgatcccctgccaaacaaaaaaaacacgggagattatcaattcccatgccgatgtgtacaatacgatcagtcttgagctgaatgaattgaacaatattttcaacatcagtatatccaaagctgaaattgccacgattacacagatctttctggaatatatgtaatcaaaaaatcgtgcgccccgcttccggcttatactttcctatttcatatcacaaaaaaacggaccgctgcgctataccggcagttgtccgttttctttatgtatggatggaaaaatcaggcaagctcagcctcgagcttttcaatcccctttgcaatacgcttcagggtttcctcttttccaaggatatgagcgatttcaatggcaccgccaggtgtaaactgctttccggtgatggcagtacgaaccggccataaaatctgcccgttcttcatttccatctgcttcggtaaagacagcagcagctcatgcagattttcttcgctcgaccagtcattcagctctgacagggcactttgtgccgcctgcaatgccttatatgcaatttcataggtcgtcttcattttcttatgaatatacatggcattatcatattccggcagctcgtcaatgaaatccagactttccggaatagaggtcagaatatcacatcttggctgcagaatgcgtgcaaccgccataatatccaccggtctgtgaacggattcctcgatatacggctttgccagctcacagaatgtttccgtgctcatcgcgcgcagatacataccgttcatccatgtcagcttgtcaatatcaaaaatagccggtgatttggaaatacgcttaatatcaaacaccttgatcagctcatccagtgtatagatttcctgctctgtttccggtgaccatccaagcagagcgatgtaattcagaatcgcttccggaagataccctttcttcacaaggtcctgaaagctggcatccccgttacgcttactcagcttgtgctgttcatccttcataaccggtggaacatgcacataggttggaatatcccagccgaaggactgatagatcagattatattttggagtggaggacagatactcgtttccacgcacaacatgcgtgatacccatctggtgatcatccacgatattggcaaaattataggttggatagccgtcgcttttcagcagcacggattcatccagaatactgttatccacctcaatgcggccatacacctcatcatcaaaatacgtttctccatcgtgacgaatcgtctgacgcacaacatatttttctcccttggcaatacgttctctggcttcttccacagacacatgcttgcatggatcatcgtatttgaaagagattcccagactttccgcctcttttctctgcttttctatttcttcctcaccgcagaagcagtaatgtgcgcctcccagatcaaccagctgatcggcatactccttatacatcggcagtcgctcagactgtacatacggtccgaaatcccctccgatatccggtccttcatcatgatgcaaaccgacttccttcatggtatcgtatatgatttcgacagcgccttccacgtaacgttcctgatcggtatcctcgatacgcagaataaaatctccgtcctcatgcttggcaatcagatattcgaacaatgctgttctcagatttccgatgtgcatatacccggtaggacttggtgcaaatcttgttcttacttttttcatacgggccttcctttccatttattggtttctatatatagcagcagcttggcatttccacacagggtgcttccccgcaataaaacaaaaaagtcgccgaagcgactctcgttttttattggctggggtacttggattcgaaccaaggaaatgccagattcagagtctggtgccttaccgcttggctataccccaatctctcagcggcaacgacattattctacttgttttccatgcttttgtcaatagcttattttaaaaaattcaatttttttcagaagacggtccctattcaccgatttatagtatagaaaacagcttatattaggtaaaaaaacaaaactatcgcatagcagttgtctcatacataaagaagtcccctctatggtatccttaattgatttgttatctttcgataaattgaaacaggagctgctcaccgaaaggttaaaagcaggaaaatggctaatcaaatacagatatagcacgagatcggttttcatgacttgtatatatagtagagcactatcatcgctaaattgataatacaatgcaaaaagaattacctttccgcatgacatatccttatgcaaacagccgcttgaaacgcatcctctgaaaagctatccataatatctgtataaggaatctaaaaaaagacgattatcaacaaatagagtatgcagactttctcaaaagagaaaccgataaaatgcaggaaagccatactcgcatacggtgtatatcaccctgctgggtctcttgcattttgttatcctattatattttacattctcccttttcacgcgatgcttgacagcacttcaaaatcgtgggataattttgacgaaatcgatgagagtaactcacctgaggcttaaccagagatttgtgcatagtactacgcagtaaatgaaggaagcaaggaagatatttgttttctagattaggagcgattatgttcggattgaaaaagaaaagcagaaaagtggaattggtttcaccggttaacggaaaaatgatacgcttacgtgatgtaccggaccaagtttttgcatctgaaatgatgggccctggagttgcttttatttccaacgacggaaacatatgttccccatgtgatggtgaattgatgactgtatttcccacaaagcatgcgattggaataaaggcagagaatggagccgaaatactaattcactttggaatagatactgtccaattagaaggaagttgtttccatcaaaagatagatgcaggaaacaaagtaaaaaaaggtgatttgattatagaagctgatatcgaagcaatcctcgagcaagggtatagcatcgatacacctatgattatcacaaatgcaaatgaattccatgttacgattcatcaggctgatgccgttactgtaaacacggctgcagtcatatcgatagaaaagaagtagagcatatggaagttataaaaaagctgggaaataacgcggctatatgcagggatcatagtggcagagaactgattgcgatcggattgggcattggatttccaaaatgtccttatatcttagatgatttgagtaaaattgaccgcacgttttataacgttgatgcggaatatctaagtctgtttgaagatattgattcaaaaatctttcgtatttctgccgatgttattgatttggcagttaccatgctcagtgttcccttaaaacaaaacgctgtatttacattggcggatcatttaaacttcgctcttgttcgtctgaaaaacggaatgatatttacaacaccgatagcaaatgaattaagagatttgtatccggtagaagtaaaaatcgcaaaatatacgttaaatttattacataaaaatttaaatgtacaattaccggaatccgaaatatatgcaattgccatgaatattatcaattctgaggagacctacacacggaataatcaaatcagccttacagcagaattcattcaggaaatcgtgaagattatcgaaggacagatgaaggtttcgattgatacaaattcatttaattattccagatttgcttctcatatgcagtatttattcagaagaaaaagccagtacagtgaaatcagcagcaccaataaaaaattatttgaagttttgaaaaaggaatatccagatacctttgcctgtgtgctgttgatcaaagaaatgatatttcataaatttagctggagtattgaggatgaagaatccttatatttaatactccatgtaaatcgattgtgttcccatgagggtgtaacgaatgaatcggcataacctttgcacaatataaacatcatctgatgcttatcgtgtaaaggtttttattttatagaaaatcagagaggataaaactattatgaaaaaagataaagctttaaaaattgcagaaagtgtattagaacaagtcggtggaaaacaaaacattgcgaaggtgttgcattgtcaaacacgtcttcgcttcaatctaaaggatgaaagcattgcaaatcatgaaaaaatagaagcggtacaaggtgttttaggtgttgtaagagccggtggacaggtacaaatcgtaataggtccagaggtaaaggatgtatataacgaactgtgtgagctgggtgattttgataacacggacagagaacctgtttctgccgcaaaagaaaaaatcacactgaaatctatcggaaatggaattttagatgctatttccggaagcatgggacctgcgattccagccatcgtcgcctccgcattctttaaaatgctgacagctattttaggtccagagctgttaaatgtcattggtgaaggaaacgatctgtatacattattcaccttcgtgggagacgctgcattttacttctttccggtaattgtcggctatacaagtgcaaaaaaattcaatctaaatccggtaatggggatattgatgggcgcaattttgatacatccgacatttgtcggtctggtgggtaaaccatttactgtatacggtattccctgcaatgttcaaagctatgcaagctccattgttccgataattttatcaaactgggtaatgtcctatatcgctaaattcttcgatcgtatcgttccgggggcaatccgttctgtatttgcaccagcactgacaatcgctgccatgctgccgattgcattatgtgtcttcggtccggcaggagcattcatcgggcaatatgtagtagatgcattattctcgttggaaggaattgcaggattcatcgggatcggattgattgcggcattgtatcctgttctggtaatgaccggtatgcatatggtactgattacaacattatttcaaatttttgctacctatggaagtgatggattcgccgcagtagctgtttccgtctccagcttctctattatgggggtaggaatcggtgctttcttccgattgaaaaataaagaacaaaaggcacttgccctgtcttatgggataaccgccatcgtcgcagggacctcggagccgacgatttacggtatctgcacaaaatacaaaaagccatttatcggacttttggcaggtggtttcttaggtggagcatatgccggtttaaccggtgttgtcgatgcgacactggtaccatcctccaatgtatttgcagcattatgctttttaggaggctctcaggcaaatgtaatcaacggtatcatcgcatgtgcaatcgcttttatatcaaccgctttattcgtttactttttcggatttaataaaaacgaaaaggatatccaacgttaatatcaatgcgattagagaaggaacttcttcctatagctcagatacacaaaggagtgttctatgataaatacaaggcttacattaccgagtggtgcgtatgctgatacgtatattatggattcggaaatcaattatcgtgaatacagaaagcgacctgcaatccttgtggcaccgggtggcgcgtatgccgttcatgcgacaaaggaaagtgaaccggtggctattcaattcatgcaaatggggtatcaggtatttgttttaaaatattcggtaggctcagatcgctcgcgaccggaaaaaggcattataaaatccgcagtatatccgctgcaagctgttgaaatgctggaagctttacatattgtaaaagagcatgccgatgaatggaacatagataaaaaccgaattttcttaatgggattttctgcaggcggacatgtgtgtgcgtcttgtggtgtacgatggaatgaccccgcaatcgtaaagcaattaagctttcgcccgaaaaaagatgaactgaaggcagccggaattgttttaggctatccgttcctggttccgaatagtgatgaatttttcaaaaagcatcctttaaaagctgtcgaaaaggtacagcatattatgaattatgttctttatcaatcagattttccatcacagaaggatgtcgaaaaagtgaatttgataaattatatttcacaggataccgtaccgatgtttctctggcattccattgatgatccagtcattgatgctggaaattccacacgctttatttcaaagctgttggaatatggcatatctgcggagtatcatttatttggtcatggcgagcatggaaaagcattggaaaacagtttaacgcataaaagggatgagatgatcgatcatcatttgaacagttggatttctctggcagattattggatgaacaggataggtgaaaagtaagatgagaaaagaagactatacgatttttgaatatcgaatgagcaaagaaataaaatatgctgatctgatttataatgaaaaaatgaatggtatattcgaaaaagtctgtgtaaaaacaaaaaccgcaggatatgtggatatgtcgatttatcgtcccttgagttgggatgggaagcagattttaaagccggtatttaactttcatggtggaggcaatgtattgggatactatgagcaggatggaaaatattgccgtttattggcggatttaaccggctgtgctatctttaatgtagactatgttgttgccccggaatttaaatatccaaagcctttattttccagctatgaagcaatcgctgaaatacgaaaacgctgtgatgaagtaaggattgataaagagcatgttgtcgtaatgggacatagtgcaggcggttatatttccgcctgcttgacactgattgaccgagacagaaaagaactcggtatcaaaggagccattttagattatccgccattgcgacaggaaatccgtgcagaattcagaaaagcgaaggacccttcaaaggcgatatccgaaaatagaatgctgcagtatatcaactggtattataatagctttgatgagctgaatgatgaactcgcctctcccctactcgctgatttgcatgatttgccgaaaaccctgatcctgagtgcggaatacgattctttaaaaaatgaagaaaaggcatatgcagataaaatgcagaaggcgggaggagatgtaacctatgttgaatttgcaaattgccgccatggcttcacccatgaatggtttgatgaatttatgccagaggaatccgaaaaagcatggaatatgatggcagcatttatcagagggataatgtagaagcatggcgcagaagaacttaaactatcatgtaatgcctcgaaggggctggctgaatgatccgaacggcttggtttattttaaaggaaattatcacattttctaccaggcagatgaaaacagtatggatggaagtgtcaataaagcatggggtcattatgcaacgaaggattttcaaacatatacacgtcatgctacggctgtttctccggattccaaatacgataagaacggcgcatattcaggaagtgcaatcatcagagatgacatactgtatgtattttataccggtaatgtaaaatatgagggcccctatgattttattcatgagggaagagagcataatgtaatgcgagtggaaagccgtgatggaataacctttgaacataaaaaatgtttactgcgaaacagtgactttccaaaggattgtacaaggcatgtcagagatcccaagctgtttatgaaggatggccgctatcatttaattttaggtgcaagattgaaaaatgacaccggctgtgtattggagtatgtgagtgatgatttagaatcatggaagtatgctcatcgctatgtaccggcaaaagatacaggattcatgatagaatgtccggactacctgcaattacaaggagaagcattccttttatgcagtccgcagggtttaaaaaagcagggctatgaatttcataatgtatatgattgcggatattataaaatcagcaatcggcaactgattgattatcagacacttgattatggatttgatttttacgcagcgcaaacgttttacaacgcagatcgtaatatactgattgcctggattgggatgccggataatgcatatatcgatcgttatgaagcatggaatcagaccctgacgatgccccgctccattttctttgataagcgaatcatccaaaagccgatacaggaaatcctggatttgagaacagataggaagctgtatacgaatgattttgtaatcggtaaatcctgcaatatcgaatgggatgcagactccgatttttcgctacaaatgaatgcgatacgctgcgtgtatagaaatcataaattcacactggatttatctgcatgcagctgcaatcggcaggaaagatgcattacgcccatagaaatccgtcatgtttctgtattcattgatgaatctgtattggaaattttcatcaatgaaggtgaatacacaatgacctcacgattttatgatgatgagcacagcttacacgtaacaagcgagaatataaagcgatttgtaacatacaacatgagaggattcaatatactatgaaaaaattattagcaatcggagaagcgttgattgatatgattccaagcaatacaggaagaattatggatgtagaaggctttcaaccaaaagtcggaggggcaccgttgaatgtatgcggagcatataccgcattaggtggagaaagcgctatgattaccatgcttggcaaggatgcctttggtgaaaaaatcataaaggaaatgcaacgattccatattcatacagagtatataaaacaaacgaatgccgcaaatacatctttggcatttgtagccctggacgaacatgcaaatcgagagttttcattttatcggaatatgggtgcggatatgcttttatcagagaaggatatagaggaaagctggtttgaagattgctatggtttgcatttctgttcggtttcccttggtgatttccctatgaaaaaagctcataatcgagcattggaactggcaaagaggaaaaatctacttgtatcctttgatccgaatgtccgtcttcctttattcgacgatcacgaatatctgagaagaacgattcacgaatatatgcactttgctgatatcttaaaaatcagtgatgaagaggtttcctttatatttggaagcgatcatatagaagaacatgtacaatatatatttgattccggtgtaaaattactgatttacactgccggaaaagacggtgcagctgcctatacgaaatacaatacggcatacgcggatggtattgaggtaaaagcagttgataccaccggtgcaggagatggttttatcggatgtttactgtatcatctatccaaagatgatattcatgcttctgatttggatggattaagcgaacaccaattaaaaagctacttggatatgtgtaataaattttgcagtatttctgtaacaaaggaaggtgctatcgcaagctatccatcccggtaggattcacgttaggctatcatcaaaagcatcctgtaagcaaaacccgcccacacagcgttgtgtgtttctgtggtatctgttttacaggatgctttttacaatatacgaaaagccgattccattgataacgtacagttcttttccattggaattagaaggctttcactatgcatgctcatttgcttgaacatactttgcgctggatatagcggtacaaaatatgaacgcatcctccctcttttcgcgaggatgtgctttcatttactgacagcttgcagatcgcagttgaatgacatgttgactatatgctttttgacatattcttggcaaggtaaggttctcatatggggttcgtatctttgtgcaatccccattaacaaataaaaccacatttccatactttcgtacagttgtgttttctggtacaatagcagaagatacaggagggatctcatgaagatacttgattctgaaattcagcgttttttcaataccaaaaactggaagatcgcattgcgttaccatgatcaggatgttgtggatgaaattgtgattaaggaaagcattcctggctttctatatgaaataaatgctgtcgttaacgtgtacggatacgagaatcactgcaccgttctgctgaatagtgcgggtgaaattctggatttctcctgtgaatgtccgtattgcgagcagcaggagcttgcctgtggacatatcggtgttgtcctgctgattgtgtacgatctaaagccggagtccttccccttcacctacagcccgctgaaccagagggaggatgcctttcgccgctatctggagcagcagatgctggagcgctcgcgttcctttatcgaccgctacgcccgaaaggagctggcgaaatttcaggcgaacactcttcttgacaaggtacagctgcacgctcatgccgcatatgaccatgagtttacactggattttaagattggtattcaacgaaaatatgtcatacgcagcatcagcggatttcttgatgccatagacaggcagctggaagttgattacgggcgccagctgaaattcactcatcacatgcaggcctttgatgaagctgctcaggcacagatcaattttttaaagcagtatgtcaaggagcatgaaacacagtattcctatggctacggctccagccgcaagcagattacaattgattcaaaatcgatggatgatttttatgagctttacagcaatgatgccacggagtgcatcgatctgcagtttgcggatgaagaccggcaggaaatcggactgcgcatcgatatgcaggaggacttttttgtcatcaccacgctgctgtccctcgatcagcttctgcgtggagaaaaccgctggtattatatggaagacggtgttctgcagcgcttttcctcggtgctgagcgaacagctgcatgatatgctggaggagctgcgtgaggatcgtcagattctgatacataaggatgatatgatccgcttctgtacctatgtcattccggcaatacgggaatacgtgcattttgaaggtatttctctggataccttcatgccgtatccaatggagattgactgctatgtcgatttggaggataacggtgatatctccatccgcctgctctatcattacgaggacagcccctcccagaatgcgtttgcaccgcatgccgattcctctttggagctggatcatatccgccagtatatcgaaacctatgcaacacgtctggatccggattcccatatagcctatattgatgagcatgccgcatatgcacaggcctttgtcaaacaggggctggaatacctgaatcagatgtgcactgtatatatgagtgatgcgctgaagcagatggaggcaccgaaaaaggtacatatgaatgttggtgtccgtatgaaaaaccgtctgctggagctggatgtcaccagtgtggatattccaagagatgaattatacagtgttttgcgttcttatcgtaaaaagaaaaaatatcaccgactcaaaaacggcgacctcatttatctgcaatccgagggtctgcaggaaaccgacgagctgctgcagcagctgcatctgacaccgcaggatttaaaaaatcataccctgcaggtggatacgttccatgcctttcagctggatgatttcgcagagcacagcgatcatgtcgaggtcatgcggggaactgccttccatacgatgatggaacagctgcgcagtgtggaagccggagcctatccattgaacccgcattatgatgccatcctgcgcgattaccagaaaacaggctaccagtggctgaaaacaatgagcgcctatggattcggcggtatcctcgctgatgatatgggtctgggaaaaacacttcaggtcattgcatggctggaaagcatgcatcaggatcatgatcttccctgctccatcgtcatctgccctgcctctttgatttacaactggaaggatgagattcagaaatttgccgttgatctgcgtgccctttgcatacagggaaccaatacgcagcgccagcagaaaatcagagagctgcacggatatgatgtcatcatcaccagctatgattatctgcgcagagattatgagcgctatgacgggcacacctttaccgccattctgctggatgaagcgcagtatatcaaaaaccatacaaccaaaaatgcgattgcagtgaagcagctgaagggctcctaccggtttgcattaaccggaacaccgattgaaaattccctttccgagctgtggagtatctttgatttcctgatgccgggttatctgtataactatcatcgcttccgtgagctgtttgaacgtgaaattatcaaaaacgggaatgagaaggcacagacacagctgaagcgtatggtggagccgtttattctgcgaaggatcaagaaggatgtgctgcaggatcttccggataagatggaacaggtatattttcaggaattcaatgcagaggaaaagaaaatctattatgccaatctggtatccatcaatcaggatttacaaaagagaatgcagatggaggaggttgataaatttcaggtactggccatgatgaccagactccgggaaatctgctgtgatgcgcgtttgctgtatgaaaatgtcacgctgccctctaccaagcttcgcggctgtatggatctgctgctaaacgcccgaaacagcggccgccgtgtattgctgttttccagcttcacctccatgctggagctgattgaggaacagctgcgtgtagaaaatatacggtatctgaagctgacaggggaaacaaaaaaggagctgcggcatgcctatgtggaaaaatttcagaacggggaagctgacgtcttcctgatttcattaaaggcaggcggcaccggcttgaatctgaccaatgcagaaatcgtcattcattatgacccgtggtggaacctttccgcccagaatcaggcaaccgaccgcgcctatcgcatcggtcagacgaaggatgtacaggtatataagctgattatgaaggataccatcgaggaaaagatcatgaagctgcaggagcgaaagcatatcctgagcgacaccttcatcagcagcagtgaatcaagcattaccagcatgagcaaggacgaaatcatggatttgtttacgatggagccctttgtacaggaagcggattttgatgaagcctatgccgattaacatccctcccttcttgcgggttcaggaaagcttcctttatacaataatacatatagaaaatcagacggctgtcaaagcagccgtttttctttgcggcataagctctgttgaaggcacgccaccatagataatcttatagcgaatataaagcaaagcgtatctatcagatgttacaaaccggttattcatgaccatgtcccctaatgcatcgtcaatacatactgcaggaaccatatcagccgtattcatagtatgctctgattggaaccaccgctccttatagctccttcatcccccggcaggtaattgccgtattcttatccgctattatggaataacaaaaagctgtacagatgaagtatacaagtgtatatcatccatacagcattgacggtatatatagaaagcttatgcgtgcttcaggaatgccttgtagcccttagtcgcttcccagatatcaattttgctggcaatctcccatggtgcgtgcatattgtgcagtgcgataccgctgtcaatgacctccatgttatactgtgccagaatataggcgattgttcctccgccgccctggtcaaccttaccaagctctgcagtctggaaggttacattttcagaatccatgatgtttctcagctctgccatatattcggcattggcatcattgcagccacccttaccgcgggagcctgtatatttattgaataccagaccatgtcccatgaatgcagagtttttctcttcgtttactgcagcataattcggatcaaacgcagcagaaacatcactgctcagcatcttggaatttttcagtgcacgacgcacattcagctcgctgtactcaccaagacgatccataacctctgccacggtgttttcaaagaagcgggaatgctgaccggtagcaccgatgcttccgacctcttccttatcaaccagcagtgtcacagccgtgcgtttaacggattctgtttccagctgtgccatcatagaggtataggcgcagatgcgatcatcatgtccgtatccggccaccatactgcgatccagaccgtaatctcttgcctttccggcaggtacgacctcgatttccgcagatacaaaatcatcctcttcaaaatcatatttttccttcagcagcttcagaatgtttgccttgacagcatccttttcctcaccatccagcggcatgcttccgatggttacattcaggtcttcaccctcgatgacgttgcttgcctttttgctcatctgatccgctgacaggtgtaccagcagatcgctgattcctacgattggatcgctgtcatcctcaccgatattcagctcgataaccgttccgtccttcttcacgactacaccatgcagcgccagcggcagggttacccactgatactttttgataccaccgtaataatgcgtatccagcattgcgaattccttatcctcatacaaaggattctgtttgatatccagacgcggggaatccacatgtgctcccagaatattgcatccggcagccatcggctcctcaccgatcagaaacagtgcaattcccttgcccatattgttggcatacaccttatcaccgcttttcagcgtttctttgtttttgatgacatcctccagattgcgatatccgtaggtttccgcaatccggatactttcacttacacattcacgttcagtcttgcagtcggaaatatattttttatatccttcacaatattcgaatacttccttcaatcctgcttcatcatactttttccaagcattttctctcatagtctacctccgttgttcactgtcttctattataattcgtattcatgataaagacaactccaatactgccgatttaccttatctttccagaagctcgcgggaaagcttcagaatagcctccttgttcagggaattgtatatgcgtacctcacctgcggcagaggaaggctttctgcaaacgcctcgttcctgcagcagctcctgcacatgacgtgcagtacctgcattgccatccacaagtgcgatatgatcaccgatgagatttcgaagctggctgcggtagaacacaaaatgtgtacagcccaggacaatgctgtccatgcgttccatatcgtagggctttaggtattcacgaagcgcactgtttaccgctgcttcatcctccagtctgcccgcctcaacaagctccaccagctttggacacggttgccggtaaatggtattatcttcatcaaagcgggacatcagctgttcaaactttttttccttcagtgtaaactgtgttgcgagtacaagaacatgctgctgatgtctgccatctacagcgggctttaatgccggttccattccgacaatcggaagatcgggatacagggtgcgaagctccttcacacaggcactggttgccgtattgcaggcaatgacaacggccttgacaccctggctgataaaaaacgcacagatgctgcgacaacgcttcgttatttcctcttttgtttttacaccatagggagcaaagctggaatcaccgtaatagaggtaatcctcctgcggcataagagaacgcagttccttcaacacgctgattcctcccagacctgagtcaaagacaccaatcgccttgtctatgctggacatatgtatcaacctccaaaatcatatacaataaacattataccctttttttggaaagcttgcatctgttttgaagaaaatcagacacgtttgcaaaggagtaacgatagtcaggtagaacacgcttctttcggcatagagccagccggcaaacagttcattgtatcagcggttgtatggaaagaaaaaagcagctgtatgcgatacagttagaaagacagccgcaaggtgctcttacaaatagaaacattcccgcacacagaaacagaacatatgaaaaaagaaaccggatagtattttcaaagccataccatcttggttcctttatccatagaaatattatgaaaggaaaaaccagacagagcgagtgacatttcctttttacaggagcttcatcaatggaagacagcacctattcaatctgacgattcctatccttacgcatacgctgtacagggatgggaaggcctccagacgaaatgtatgacagcaagcttaaattcatgatacttttcttcataaataagcagtgctgaatatcctccagcatcagggcacggcaaacaccaagtcaatacgcttttatatttttcttcataattgtttaatctgcagtatatccgctttctatgattataggtagaggcatgaactagctatctttttcacgtgttcgcatctctttcaaagtgaactaccgccttctccaccctcttatcccagataagcggaatatagcttgtgtaaagatatatgaatcggtataatggacatatgaggtgagcataaatgctacaaatgacaaaacgacagaaaaaactggttgcatgtctgcacaatcatcccagtgaattccgcagagcggacgatttagcaaaggatctgcagctatcgcagcgtaccattcgcaatgaaattcggcagatcaatgatctgttcgacgaaccgttcatactctcctggaagggaaaaggctatcaattaaatccaaataatcagcttccagacgacgtgatggatgtagagtctgatagtggcagccgaaagtttcatattctgaagcaactgctttcctgcgatcaggtgaattactatgaactggcagatgcatactacatcagcgaatcaacgctggataaaaccctgcaggaattgaatcacatcatacatacacgatacgaaaacattagcattcagcgaatcaacagtcaggtacagatagactgtgatgagaaacagagaagacttgtatattcctgcttcctcgttcatgagattcaggaatatgattttgatatccgcaattacacaggcttcttcagctcctgcaatattttagaattaaaaagctacatcgtaagctttaatcgaaagcaccatctgggcatgcgggattttgagattttttcatttattcttcatatcgctgttatgatggaacgcattgcaaagggctgggacatcaataaccccaaagaacaagcagaagaaaaatcacaaaagctggctgaagaattttacaaaggcttatatgaacagcagcatatcatcctgtcctcctcggaattaaattatctagccttgctgttttcagggaaaatatctcggattacatcagaaaaaattcaggattacgaacagtttattgaggatattataagggatatcaagcagatttatgatatcgacctgtcacagaacgaatccttccgtgacagcctgcttgttcacctactgggtcttgatgcacgtataaaaaccaattcctttttaagcaatcctctcattcaggatacaaaacagcattttccacttttatatgatatgagtgtttatgtagcatcccgtatacagcaaaaatttcattgtgcgctgattgaggatgaaataggttatctgacactgcacctcatgaatgcggtagaaaaaatccagcagaaactgaccagaaaaatcatattgatcacctctttgggcagagcacaaaatcaatatttgatatcaaggctgacaaatgctaccagtcattttcttattgaggtcattcgatgtgtatccatctttgaaacatctcagattgacgagcttacagcagatctaatcgtttcaaccatgcctatgaagctgcatacagatatcccgatatacacctgcagtaatttcttgcatgatgcggaaatcgaacagattctcatgctgctatcaaaggaagaacatccctccaagcggttgcagcagcttggacagttttttgatgaacagctcttttttacagaaatggattttaccagtgatcgggatgtaatccgttttttatgcgaccgactcatggaagcaggctgctgtgatgaagaattctatgacaaagtcatagaaagagaacggatcgcccccacagcatatgggaacctgttcgcgatacctcatcccattgagaaatgtgcatttcgcaatgctattgccgtatgtacacttaagcatcctattgtatggcagagtaagaaggttcgtatcatttttctattctccttatgtcccgggcataatcgtgatttcgaggatatctttgaacagctggtaagtcttctcaatgatgtcagcaacgtcaagctgctgctgcgtcagaccacattatccggctttctggataccttcagctcactttagctatttgttgtataatagtgaatcgtgtaaccttcatccagataacagatggaactgctgtgtaaatgtctcatcagccatggcaccatagccttgcatcccgctatctcacagcctgcgtgatttacaacaatcattggaatatgctgatcgattgcatactgtgcagcatcataattgttgatgccgtcgtcactaacgatgaccgcatccggataaaattccagaagctcataaagattcgttgcggcgccacatccgatggcaattcgatgaatctttttttgtggatccccaaacatataaactccttgttcaccatcctgacgtaagactttagcgacatgatgtgccagtgcctccgcagtcatttcaggtatggatgccgcctgatagtaagaggatacaatacgctcttcaaatttgaatccaagcctgaaagcccattgatctgcaacgccgtattccttaatacagtcccacacatcatgacagcggtaaacgctgattccatgctcctgcaatatccttttcttttcttctgccgctttgattgcagctgtatgcatctgtgtagagcattgataaaacggattttcatgcgttatgatgaaattgaccttttgtttcactgctgccagtatcgcgcctttgctcgctacccagcatattccgattcgtcccacttcctgctgatcatctccaaacagaagatgatctcttgttttcatattgcggcgcacccaggtgccctcctgttccagcagtgctgtaacttcacatatcttcatagcaatagtctcctcttcataaatttcagatatcgaaaaaacacatcagagatgtgcttttcacatagttttattcttctgtttcttccatggcttccaaacgaacacactgtttttcatgtgccttgaagaacggataatacatggcaatgtcaagaataatcagagcaataatcaggaacagtgcacgaatatccatcgttgacagaaatgctcccggaagggatggcatctgccacgaaagcatggcaaatgttcttcctatgatgttatacttcatcaaggtaaaagctatgactgcattcactgttgatgtcataagaaacggtatgagataaaacggattcagcataatcggcacaccgaagataatcggttcaccaataccgaagaaggatgggagtatgccaatacgccccactgttttcagctgctttgattttgagcggacaagcagaatcgctaatgctaatagagaaccgcagcctccgataatgacgaaatatacccagaatggtgttgtaaatacatgtggcagagcttctccggcagctttcgccgctgcattgattgacagatttccatcacgaatcggtcccaatacaccagctaaggcagcatcatggataccgaaaaaccagaagaagtgtaccagcagggtcataatcactgtaaacaggagactgtccgctgcctggaaagaaggagccatcgccccgtatataaaccccggaaaggttgtgttaaacgcatggaatacagcatacactgccacatagcatgaaatgatgataaagcccggtaccagtgatgcaaatgtttcagataatgatgccggtacgcttggcggtaaggttatccttccccaattatgggaacgcatgaaatggtatgcttctactgtgaaaatcgcaatgatgatcgccggcaagagaccgcgcccatccatataggaaatctccgcaatctttccatcccagcctaattgctgcggtgttagtacgagcattagaaacccacatacagaaagcatggtaggcatcaatacatcgtgcttgaaatgcttcgtcagaaaataggtaataccaatacatacataaaccgccattccccccagtgttaatgcgttgatccatgacagcagcgtagcattatcctgtgcaaaggatgcccatgccagaagaaagccgtttgttgtctcctctgtaaccggtgctgcaccgatgacggcagccaccccacccatcagtgtaatcggcattaaggaaatgaatgcatcacgtattgcttttaaatgcctttgtgaacttaacttattagccagcggcagaatatgtttttctatcttctcgttaaatgtagcgaaactcataactgttctcctccttctatacatcagtctttcagtatttttttgatttctttatatacacccttgccatccatcatcccgtaatgctgtggtgcaatggctttaaccggaactgctacctgtgcttctattgtcggaatctgatgacgaatctgcggacccaccagaatcaaatccactccatccatataattgatgaactctgcctccccataggcatgaacctccatcgtaccttcactcgcctcctgaatacgtttcgccagcattcctgttgacattcccgcattgcataccagcataatctttttcatagtctttcctccctgtctcagctcttttgctgctcaatcatatttttaaaccagtaatagctcttcttcggtttgcgctgcaacccgttttcaaaatctacggcaaccaggccataccgcttttcacaaccattcttccaggaatacaaatcaaaggagctccatgcgaaatatccgcgtacatcagcaccggcctccatcgcctcatgcattgcctgcaaatgatccttcataaaggatatacgataatcatcctccacttgtttcactgtaacatcctcatacattccgattccgttttctgtaatatagacaggtagattgtatttcttcttcacctcaagcagaccatcctttagtccctttggataaatttcagtatcccattccgtataggtactggcaggatcatgcataacctgttcaaaccagcctttgacaatcactttgctgcttccctttccctgctttccgctattgttcacaataaaggtggtttctccttctgtatacggcttgaccagcgtacgcgagtaataattcaatcccaggaaatcaacggtgtaatctttgataatctgcagttgtgcgggctttatcattgaaagatcatacgttttagacagctcactaagcaaatcaaccggaatttctcctttggcggcagtatccagaatccagttgttgcaataattatctgcatagcgcatggcgatccttgtatttaccgtgtcatcgaccccgttcaccggtgtaaagctgtgcacaataccaatcgttccgggatattttccctgacggaatgcacgaacaccaagtgcactggcatacataacatgataagccgcatgaatcatcgcctgtggatcctgtctgcatggcggataattaccaattaaataaccgcttgctataaaccatttcggctcattgaacgtaacccaatgatttaccttctcatgaaaattgtcaaagcatactctggcataggtttcaaaggcctcacaaacttcttcattctgccagcctccgcaatcctcccaatactgtggaagatcccaatgatacagtgttacaaacggttcaattccatatgtatgacaggcatccagcagcctgtgataaaaagcaattcctttttcgtttatctcacctgctttatttttaatgattctaggccacgataacgaaaaacggtatgcattctgcccgccctctttcatcatacgaatgtcctcttcaaaccgatgatagtgatcacttgcaatatctccgttttccagcccttcttcatgcaggtaatgatcccacatagattctgctttatcatccagattccatgccccctcacattggtaggaggcactcgcaccaccccataaaaatttatcgctcatagttttccatcctctcatataactcaatcagctctccactcatctccacagcgatggaggaggaagcaatgtgatcttctgcgtgaatcagtagaagattcatatccagctcaccttcctgattagccatgatgcgcagcagcttcgcatggagcttttgcgcctccaccatttcttctttcgctatgctcagctttttttcaccttccttaaatgcattgctttttacaagctgtaatgcttcataggcagtgctgcgcgcattcccgctgtgtaatatcagctgaaaagaatattgctcggtatcaatcatcataatctcactccttctttaactgcctttatcttacacctttatttcattcattaaaaatttacatttgccgctgtgcagcggtaaattcacaacctattttaatagctgattacagattacacgaaagacataaaaatacagttgacttcctttccagaaaaaggtaaaattaaattacaattaagaatcattcttaatttagttatagaggagataagcatatgagtaaacatttatccatggatgtacgggttccaatcgaggaaggaaacccggccattcgcagaatcgaaagtctttgtatcaaatgcggacagtgccgggacgtatgtcagaaacagatttccgtcggtcatcattacgaccttttaaaaaccggtgacacagctatctgcattcattgcggacaatgcgccaatgtctgccctaccggtgccatcacagaaattcaggactggatgcaggtacagtctgtcattcaggacagcagtaaaaccgtaatcgccatcacatcgccaagtgtccgcgtttctctgggagaggaattcggtatgcagccgggaagctatgtagaaaagcagatggtaggcagtcttcgtgcacttggattcgattatgtgtttgataccacctttgccgcagatttaacaatcatggaggaggcaagtgagttaattgagcgtatacagacgaaacagccgctgccgcagtttaccagctgctgccctgcctgggtgaaatttgcagaaacctattacccggagctgctgcctaacatatccaccagcaagtccccgatttccatgtttgcgccaaccgtcaaaacatggtttgcggagaaggaaagtctggatgcagatgatatttacgttgtagccatcacgccatgtacagcgaaaaagtttgaaatcatgagagaggaattgagtgatgccgcaaattatctggaccgcaagccaggacaggactgcgaccgtgtcgtcacaacaagggaactggcgagctggatgcgagcgtgcaatctggatttggaaagcgtagaggaaagcgattatgattctttaatgccaagaggaagcggtgcgggcattatctttggaaacaccggcggtgttatggaagcggcgattcgcagcgcatattattttctgacaaaaaagcagccgcaggaagatcttctccagctgcaggctgtgcgtggtttagagggtgttaaaacggctgaactgacgattcaggagctgcctttgaaggtggcggttgttcatggaaccgatcatgccagaaaatttctgcatcatataaaagagagcggtgagcattttgattttgtcgaggttatgacttgtccgggcggctgtatttcaggcggcggacagacaaagcatatcggcgaggatatggatactgttcggaaggcaagaattcagtccctgtatgataaggacagcaccattacactgcgcaactcccatgataatccgcatatacaacaggtatatgaagagttctatggaaagccgctgagtgaccttgctgaggctctgctgcatacaaattatgaagcaagaaacgatttacaggaggatccatcccgctatgaagctatgtatcaagcggatgcacctgtacaggagcccgtcaaagagcaggctgcggatgtacgctatcgctgtaccatctgtggttatatctatgagggcgatatcacgaaagaaagtgatgattacaaatgtccgatctgtacagttccaaaggatatgtttgaaaaggtggaggatgcatctgcacaggagcccgtcaaagagcaggctgcggatgtacgctaccgctgtaccatttgcggatatatctatgagggcgatatcgcaaaagaaagcgatgattacaaatgtccaatctgtacagttccaaaggatatgtttgaaaaagtataatgtttatttgagcgcaatacctgtgcattaacacaggtattgctttttttcggtaaggcgcagagtatttatacacaaaaatcaagcagctgatgttgaataattccaatgtatcttatttcagaagcttcgtaatgacaaaaatcattacgcgggcattccctgtttcttatcgaatatcccttgtctacgcatatataaatttctcttttaggcatgcagaagaagtatgcttaaaatcaaaaaaaggacactcaggtcctttttgctcacttcagaagcattcattcagtcattcaaccttttcatatccttcagtagttcttccagcttctcttccattgtatcatccgaaaactggcaggtaccgacaacacggtgaccgccaccgccatatttcagcatcaatgccccgacatcaatcgtacaggttctgttcagtatactgtagccaacagctgcagaacagcccttcccacccttaccgttcacaatccacacagagatattggcatctggatacagactgtaaatcagaaatcgatttccggtataaataggatttacacctcgcagatctgagatgataatcctgttttcgacggttgtatgtgccttcaacatgtcgataaatttatcgttctggtcccaatacagttcaattctctctctgacatctgcttcagccataatttcatggatatcctttgtcctgcaccagtcaatcatttcttccattaaagcataattgctgattctgaaatcatgaaaccgtcccaaaccggtacggggatccataataaaaccgagcagaatccagtcattgggatgcagcacctcatctatgcttagattggcgctgtccaccttatccactgcttccagtaaatcatcatatcctggaaaccgctctctgccaccataataatcatatatgatatgcgcacagcttggagatgttcgactctctcccctgtattttcctttgtatgcattacgttcatcttcactggaatgatgatcaaaccacagaccgcagccttccacaaacggtacgttcgcaagacagtcctccctcgtaacctcaaccagaccatcctgcaagtcctttggatgtacaaatttccaatgatcgataacgcctgcttccttcagaaacacggcacacgccaatccatcgaaatccgaccttgttaataacctcatgtgagctcctcctttgatatataccatcagtttaccacttaagataggcacaaacaagagaaaccccttacaacaaggtcttcttttccggaaacaaatctttttcaggagatatgctatcctgatagcatctacatcgatttctgaaggcgggaacgataaaaaagcagcaggagcatatcctatagatccatggataagcggttattctatcacccacagactaccatgagaatctgcctgttaatatatagaagctgtcctcttttccccagcatcaaaagacagcatccgcgctgtgctgtctttttgtgacatgaaataataaagttcttatctatatgaagtctttatcaatctcttttgtatattcaatttattgtttaacggaagtgctccagcagcatcttctctgcctctgcactccacaatcccctgtttttcttgcatacagcatccagctccttaaagaacggatcctgttctcccagcttaccgaaatcatcgatagctgtcattggcatattgatgtgtgtgtaaacaagctttttaccaccgggaacatccggcagattctttgttgtttccactacggaatccaagcctccgacatgagtgatcatgaccgcagatttgatcagcccctgtgcctctttttcaatcgcttccttcatatcatcaatcgttccaccggtagaaccgataattttacttctggaataatggcagtcatacagattgatcatggatgagaatttcatatccgtcggtccggcaaacagattcatacagccgtcatatgccatgatactgtttcccatttcacaaaccgcacggtttggaatatacacaaagacatcatcatagccttttccatccgtcagtgccatgagctcctttacctgatcctgcatagtggcagtatttacatatataagctccactccatgcgctgccgcttcttcctcgctgatgacttctcttgcacgattgatacgctcatcattgatttctgtaacaacgatacgcttaggtttattctcaaaggtaagtccatagctgattgcccccaatcccatcggtccacagccgccaaggataatgatattaccgccttttttggttcccatcacatgctgataggtgcctggtaccgtatggtaattggtatggtagccaccgattacacagctgacaggctctgccacactgcttgcgaaatagccgtccccttcaaatgtccaaagacatcctgcttcaatgatatcattcgggaagatacaatactgcgtatcgccaccgcaccacgcataggaatatcccggactttccatctgtcccggaatagccggctgctgtgcaaacttctgacccggctgaaaattatcctgccatttctttcctacctgcacaatatcccccgcaaactcatgtccgataataatcggatgatccgccacatcattgggaacacgcttatgattggccccctgctttactgttttccatgtagacatacagatgctgtcactgacaacctttaccagaatctcatcatcctttatttccggtaattcaaattcatccagacggatatcatcaacgccatacaggcgtactgcttttgttttcatatcaattttcctccagtttcttgattgtgacctgcttcatcagcttttcgacaactgccttttccgcaggctgtgttcccttcgtcataacagctcccgcactgcaggcaactgccagagcgatcagctgttccattggagtatcctgttccagcgcataggcgatggcagccaccatcgcatcccctgcaccgacactggaatgtgcctgaatgtgcaaagcctctgcctgatagattccctcatgactcagaaagatactgccttgctttcccatggatacgacaacaagacggcattcctcattcagcaatgttttcgcgagtgaaatcatttcctcattcgaacagtcctgtgaaacaccaaagtaggtcgcaagctcgtatttattcggtttgatcacatacggctttgcctgtatcccctgggcaaacagctccccatccgcatccagtatcacacgggctccctgctgctttacaagttcaatcagctcacgataaatatccttacgaacctgtgcagatacatttccactcaaaaccacgaaatcattcggatgcaggagcgacagaattttatccttcagctgcttgatttccgtttccgtgataacaggtcctgcttcatttaattcggtaagctccatttcatgatccagtaccttcagattggtccgtgtcataccttccacccatacaaaatcattatcaattgcaagcccgtttaaaaccttccggatatattcaccggctgagcctgccagaaatcctgtcgcaacactttttccctgcaaagcatatatggttttggatacattgatgcccttcccccccgcatcctgcataacattgcgcagtcgattcagtccaccgggaatcagttcatccacctctgctgttttatcaattgccggattaaaggttaccgtaagtatcatgccgcatcacctgccagaatctcatacacggtatcaacatcgccagcgacaaccttttcgaccatttccatttctccaagcttctctgcaatattggcaaggatcgccatatgatcatcatttttagcggcaatgccaatcacaatccgtactctgccatccgcccacctgatgccatccggataaatcatcacagcaatccctgtctttttaacacagtcctttacctcatattccccatggggaatcgcaatgtcgtttccgatataggttgtcagtgagtgatcgcggttcagcatgccctgaatatagccttcgtcgatatatcccgcaccctgtaacagttttcccatagccacgatggcttcatcactgttatctgcacggcagttaagcagaatgttgctcttttccagtatgttgtttttcttctcttcctttttctttctgaatatcataatatcctccactatgttttcgtattcttcatcgttcataaacccctgtacactgtagtaacgtacagtaggaaactgcttctgtatccgctgtgcaaagttatgatgggatatcagaatttctgcatccggtgccacttcatcaatcgcacagtttttcacacggcagctgatgccatgtgccttcagctttttctgcagctgacctgcggccattgcgctgcttcccatgcctgcatcacatacaaaacagatatgcaggtcctccagagccgcgcgttctttatgtttatgaaataagcccatcacagtctcctttctataatgcaaccgctgtatccatgtactccatgatcagctgactcagtgcctcttctattcgttcgatatcctgtgtacagacggcttccagcagcgtttcagattccacaagacctctggagaacagggacaacagctccttccgaaccctgccggcctgtgtattcacaagcataactacggcaaatttcagattcttcgcctctgcgctccatgcatgcctgggatattgaagaagaatttccatcgtatccactgcactggttgcggcatgcagcagggcaaattgcaaatcctgcataatcaccggccccatgctctcacgcttttgtagatcggcacgtatctgctcaactgcggctgcattctttccgatatattctgcactttcaatcaggagctgggacagtgtgtcactgtcgctgatatgcagccggatgtggtccaacagaagcagactttcctcactgatggaatgcagcaggcgcagctgttcgcgaaattcgctgacaggctgcactgctttttgaatcggctcactcagctcctgacggcaggtaagtgccgttcgtatattgtgaatatcctgctgattcagcagcggtgttacgacaatcacttcccggtccgcaacatccagcgagaaggtggaaaccagcagctctgcgtcgtcatatgcatggcgctggacatcctccatggagaatatctgcagccttacatccggatgaaagcttttctgaatacgcgcggacagcatggcgctgacaccgattccactcgcacacacaacaccgatgggaatcacacggcgatgaattgcagtatgctgcatacgctccagtgatgccccgatatgcatggtgataaagcctgtttcatccgcactgattgacacgccgcagtaattttcaagaacacggcatgcctgcttcgtctgttcatataattcccggtattccgtttgtatctgcgaaagcagtggattatagatgggcagatcatgctgcagacgggtgatcgtcggtgacagatgtgtcaacagcccctgaaagagctcctcatcctccataagaagatagcgtttttcctcatcataggtctgcagcatggcatacagaacatcgcggagctgccgtgccggttcatcctgcagactgtcgtattcgaccctgctgattttagctccccggatatgcagtgcgataaatgcaatttccacatcgggtatatcgatatcaaattccagctccagaacatgtgccatctgctgtgcctgctgatagctggcatcctcctgcaccatggctacaacatcaccgccatccttcagctcctcgtttttcaggatgcgttcgatagcaatcaccagatgcataatcagaccgatataggatgcctgtgcatagcggtccagattcagctcatgctgatttgtttgaaacacgtccagaatccgcttcagaatatcctgattcagcatattcagaatacctgcatcctgatggagaaatatctcggtaagcagtgtctgggaatccagaaaattcacactttcatagctttccttgctctgtaaatcctcctgcagaagctgtgtcatcgcttttcgcaggacagcctcctccccctgaacacccacaccgacgcccggcttgcgaatcagagacagatcatgctgtcgaaaccacggctctatactgtccagatcattggatatggtagcttcactcacctgaaacaatgcgccgtaatgcaaaagcttttgaacctcatcgcttcgcagcagctcgaatatcaaaaggtgctggcgttcctccttattcagatactgaatctgctcggtattcagctcctgacgaagcgcctccttatcctcatacgagccctccatatgaatccccataccggccttcgataccagacggacatgatattcctttaattcatcatcgatatgccgaagctcccgaaagatggttcttgagcttgttttcagccgtttggcaagctcctccaccttgacatacccgtctgtttctatgattatttgtaatattttctttaaccgtgacgaatagatcatgcccttcggatagctcatagcaatcaattcctttcttataacggtatacttgtcagtgatataccggtgttatattattttgtaagctgtgctacaatttcatcgtactccttcccgcccatgaaattggtgattgggaagatcaaagcgtttggacaacgggtttcagcccgctccaccagggatttatgcgtaacgatgacctgggtatcctttggaacatcatccagcgcgaaatgctcaaccgttaccttcattcccgccgcattgagcttctttgtcagggttgttgcccccatggcactgcttcccattccggcatcacatgcaaatacgattttgcttacagtacccgcaggctttgcacccttggcttcacttttcatggagctgacggcggcacttgcttcttccagggcattgtcgtctgtgtttttattgctgaatttcaggatgaaggctgcaattacaaaggatacggcagctgcaacgattacactcagaatcacaccgatatagctgtccttcgcacacattcccaaaattgcgatgatgcttcccggagatgcggcagataccagaccggagttgaagatactgttgataaagacaccggacataccgcctgccatcaccgccagaacagtcagcggattcatcagtacataggggaagtaaatttcatgtataccgccaaggaaatgaatgatgactgcacttggcgcactgcttcttgcagctccctttccaaagaagctataagcaagcagcagtcccaaaccaggacccgggttagcttcaatcaggaagaaaatcgattttcctgcttccgcaacctggtccattcccagtggtgtgaagacaccgtgattgattgcattattgaggaataaaatcttcgcaggctccacaaacagagacgtcagcggcagaagactgcgtttcaccaggaagtcaacacagattaccagaacatccttgataccgacacaaagcggttcgattgcaaggcatccgaagacagcaagcagtgcaccaagaattcctgccgagaagttattgaccagcatttcaaagcctgccggtattttccccgcaaacaaaccatccaccttcttcatgagccagccgcccaatggaccggcaatcatggcaccgataaacatcggatcctctgttcccgccagaataccgatggcagcggcagctcctaccacaccgccccgcacatcataaaccattttacctccggtataggcaatcagtgtcggcagcaggaagcgctgcattggcgcaaccatctgtgccagtgtttcattcggcatccagccggttggaataaacaaagcagtgataaatccccaggcgatgaatactgcgatgttcggcatgaccattccactcaggaagcggccagacctctgtacgttttctttcataaatagttcccttctttctgtaaacctttcctctttacacttacagtataaaagggggagaggggaaaaacaacgaaatgaaattcatgtttggcacacccttgtatgacaatttttaacattttaaaataagcctgtatttaccgtgttttcatgaattttattatagttattatactatgaaaacgctatcctgaatagtattgacaagataaacatgttccaactttatcacttatttactactgtctgcagttcttatatatacttaaaacaactagatttctcctagattgttaaaaaagacgcattccgcgtcttttccagatatgtaagttatcttatatcatgcaatcggttcactgtataccccaagctcttctccgctttcctgtactatctgcacatccagcttcttcatttcatgatgaataaagaagaaaatgatgacagcactcgtgatatccgcaatcggtccggcatacaggataccgtccagcccgaaatgcagcggcagaaggagaatcagcggtatcagcagtacgagctgtcgcagagaagacagtatgcttgccttcatcggctgtccggtcgcctggaaataggaggtggaggttacctgaaagcctgcgcagaatactcccagatcaaagatacgcatcgccttgattgcgaattctgtaaaattggcatctgcactaccaaacagcatcagaatgatatgcggaatcagcataaacatcgcccagcctaccgttgtgacagctgttgcgatattgcttgcgagccgatagcatcgcttgatacgcttcggctgattcgctcctctgttaaagcccaaaatcggctgtgcaccgataccgataccgatacagatggatacgatgatcatggatatcttcatgacgatgcccattgcggaaagtgcaacatccccagtgacgcttgtctgatttccataatataccagcgaattattcatggcaatctgcagaattgtcgaggacagctgtgtgatacagctggagattcccagagaaaacgccattttacaaatggttgggttcaaccgcgtatgtgtcagacgcaggcgcatatttccctttcgcgtaaaataatacagcaggattattgttgcgataatctgtgaggtgatggtcgcaatcgcagctccctgcacaccccagtgaaatacaaatatataaatcgggtccagaacacagtttaacaatgcccctgcgaccatgctgtacatggcaacattcggactgccatcacaacgcgccatattgctgagaccgataccgagcagattaaaaaccgtaccaagcagtatgatgctcgcataatccttcgcataccccatattcttcggcgttgcaccgaaaattgtcagaatcggatccagaaaaaccaaaccgatcacggtcagtacaatcccgattcccaccagcagaataaatacatttcccagtgtattctccgcttcctcttccttcttttcccccagcttgattgccgcataggcacttccgcctgcccccagcatggttcctaccgccagtataatcgtaacaataggaaatgcaaccgttgtagccgcattccccagatagcctactccctgtccgatgaatatctgatccacgatattatatactgcattcaccagcatagaaatcacagacgggatggcaaatttcatcagcagtctgccaatcggctgatatcccagcggattctttgttcttatttccttcatggtctgttccataattctgcactccctttcatcgttttatgtacgctgctgcatttcctgcaatttcatccagcagcctttctgcctgttccttttcatccgcctgcagggtacggcaaaggattgcattccattccagaagcataccttgtatcaccggtaccagctgctctccctgccctgtcaggtacagctgcacgcttcttcggtcactgcttcttgtttcccgccgcagatagccgagctcctccagcttctttacggctctggcacaggttcccttatcgaagcttccggtttccgccagctcaaactgactgattcccggctgttcataaattcgcatcagaaaaaactgctggccgcagccaatttgatacggcgccagcgtttcatcgaaaaaggcctgtgagctgcgatatacgatggaagcatttttactgatatgtgccattgtcctacctctcataaaaaacaactaccttagtatagcagacaatagttgcgcatgcaactatttatataaaatattaccaatccgataagcagggcttttccacaagctgacacatgccgaaaaagaaaaaaccgcatggcttcatgcggctgatgctgtctgctgttctcttgcgatgaccttgcgaataagcttcagaatatatcgccccgtcgctacatcctcatgatatggtgaaagattgggacgtatgatgtccctggaaacatacccgtataccctggtatcatccttcagcttcacttcaatgcaaacccgaagctcctgattttcacttgccaggatcccattgattgtaaacagattggcaagctgagataccgagcttttcttgtaatactgatttttcaatgaacagctgctgatttcccggtagggtatgaccttctcctcatccatcagaaaacgtaactgcttatgctccttatcaaattgaataacatcgcgaacagttttactgggagtaaatttcggattcatcgccttctcctttccgggtttccccttcttacaccctcattatattactattcttatttttcttcaatatcttattcaacattttgaaattctattcagcgcttaggtatcgccttaacctgttcatgtataagcaaaaaaagaacagacaagcgcatagacactgaagcacgataaaatcacagcctgtcgggtatgtccgtggctgtgacttcttatcatagatactgtttcatcctcccctgccgatcattcaccgacaaacggtaaaggccactctcctatcctcagctttcgctgtccacacggtcgagttccttatgtaaaagctgcaaaatatacggatgactttcctcatttaaggtcagaaggaacgccatgtagcggcatttctgatactgctcacgctccattacaaaggtgtagcccatcctgcaccttggattgcagtcatttggatccagcagccgtttacatactgaggccttacggatttccgttttcattcttcttggaaatgcatttaaaagctcctgaaactcagcgatatgatctgcgaaaactcgaagctttatacctgatttacgttgaacaaaggtagccagtgttcttttcgtatccttacgtatataggaaacaacaaaaccgcttttggctgtcttcatctcaagcctgcatccccgcttcatcaattctgaatgaatttccgaaacatggctctgatagcggggatccacacgatccacaaatagatcaaattctccacacatatatacttcctccattcgccgcgtgcgggcatgttatcatggatgccattttaaatcgtcttaccaattttgaaatacgcacctctgtttctccatcccacacagcttcatgcctgcatacatcgtatcagaagcatgcttttctgtcctctctttttacgttcatgaactgcgagctgctgataaccataccgatatccggatgctgccgatagggcaaagcatcaccataagcaaaacatcagggaagcagaaagtgataggaaaccgttctccctttgcaggtaactgcaccgacagcacactgtatattatgaagtactctctgcacgctccaaggcagaatgaatcatccgttttcgcaatattccaaaagctgaaaggcaacgtgtacgatccggattctttcttacgttagcgggtttacgaaaaggagaattcaattccgattgatacatacaatcgtatggaatcctccatgttttgattatacccgcatttgagcatgaatcactgcctttcggttaccggcctgtttatgctttctatgctacgcctttgcacggcacttcttcagtaaacttacaatttcccgagctgtacgcatgtcctcatgatactgcagggtacctttatccacgatgtcctcagatacatgtacaaaaacagactgtcccatccgcaccttcatacgaatacctacgcgcacaaactgcctcccttccgcataggtgggaaacaccagattatgcgcaagggcttttttcagattatgatgatactcgcaggatataccgatcgtctccaagtccttgtaatagtatacctgatctccctcatctagcaggaatctcagctttttgttggttttatcaaactcaaccacatctttcatccgcttactgacaataaattcagacatatgaccacatccctatcatcttcattatatagtattcaaggggcctgtcaatgcttttcctgttacttcttgttatcctgtaatgtttatgctgttcctgttacttctgtgtattttatatcttgcgtatgatagcttcccctgtatatcggtaaagctattgtatgttacagtaagttttctaaaccgctttctttcattacctttcggcgtttgttcctgcttttccttcgccgcttgttcatgattttttacactgacataatttcacgaacatgcgtacaagatatcaacctgccggaaagccgcagcagctcctgcgtaaaactgctagtcctcttccatgatatcaacgatttcaccgcgcagaagcttgttcatattgcggatagcacacattttcccgcacatggtgcaggtatcctcacgctccggtgcagactgggcacggtatgctctggccttatccggatccattgctaaagcgaacatacgttcccaatccagattaccgcgtgctacagccatttgatggtcccaatccatagctccctttactcccttggcgatatccgccgcgtgtgcagcaattttacttgcaatgattccttccttaacatcatcgacatcaggaagagacaagtgctctgccggtgtcacatagcataaaaagctggctccgtaggctgccgccattgcaccgccgatcgccgcagtgatatgatcatagcccggtgcgacatcggtaacaattggaccgagcacataaaacggtgcccccttgcagattgttttctgcagctccatattcgcctgaatctgatgaagcggcatatgtcccggtccctcgataatgacctgcacatcctgtgcccatgcacgctgcgtcagttctcccagcgtaacaagctcctccatctgtgcaatatccccggcatcctccaagcagccagggcggcaggcatctccgagcgaaagcgtgacatcgtgctctctgcatatccttaaaacttcatcaaaatactcataaaacggattttcattcccggtgatttccatccaggcaaacatgatggagccaccgcgggatacgatgttcgtaattcgcttctgttgtttgaagcgctgtgcagtctgcctgttgattccacagtgaattgtcataaaatcaacaccgtcctctgcatgcatacgaaagacatccagccattcctgtgcagtgatatccctcaatgccttatggtaatataccagggcatcatatatcggcacggtaccaagaattgccgggcattccgcaaccagctttctacggaatgtctgcgtatcgccaaaggagcttaaatccataatggcctcagctcccatttgcacggcatgccgtaccttttccatctccatgtccaaatcaagacaatctctgctcgtccccagattcacattgatttttgtcttcagcatgcttccgattccataggatttccggcatgtatgatgtctgtttgccgggatcaccagctgtccggcagcgaccaaccggcaaacctctgtctcctccatctgttcataggcagcgacagccttcatttcctcagtgatgatatgctgtctggcagcatccatttgtgtagtgtacattgtgttatcctcctatatgtaaaaaaagctgtacgcccgctacggtgtcagcttctatgattttttccggatgataacagcataagcttccgtcctgctgtgttccctataaaatccctacgccggcattacccgtatcaggttccttgggtcccggatgatctccgatctcagccatacgtaggcaccccattttttgtacgaaaatattacaccacaaaatgacggggctgtcaatgctaattctgcaatggctttgctttgtgtatgcgatcattttccataaaacaacagatcgacacagcgggaggcattccccgtttgcattgccataccatgaacagcctgtataatccgtgttagcccagtgcttccataaattgttcggtttccagctcctgcagctcaccctgtgcaacatacaaaacagaatcaaacacctcctgtataaacagccggtcatgggatacagccagaatacagcctggaaagtccttcagaatacggcgtatgataggacttgtcagcggagacagattccgtgtcggctcatccagcagaaggacattgcagccctgcttaatgaaccgcagcagatacagcttcgccttttgcccttcactcagctgatatacggaatgctccatctcctctctggtgaacttcatccgtccgagcaattcccgcgctcttgttatatcgtccctgtcacaggcttccagcaaaaatgtcaccggtgtgtcctttgctgaaaatgcttctgcataattctgcggcatatagccgagacgaatatccgtatgagatttcaatactttatgaatttccttcatcaacagactttttccacatccgttttcaccggctatcaccgtcttctgtctaccataaagtgttatgtgaatatcctgcagaagcgtacttacgtctgttttcaattcctccaaatgaaactcaaggatacgtcggctttttggaaagccttcacactggaagaaaacatcgatcgcctcctccacgctgtccacatgcgcatagccctccttctccagcctgcgatcctgtgccttcagatttctcatttttgtctttagggcagccgcataaaacggactgcgcaccgtatcgttctgcgcatcatgcaccgcattcataaagtcattcagcttctcttttttcctgcggtattcccgcctctgtgcggatgcctcctgtgcttccttttttagccggctgcacctctgcttcacatattcctcataatttccgtgaaaaattgtatgacggcattggtttttcttattcagctgctccagatgcagaattacagttgcacacctgctcagcaaaatttcatcatgcgatatgaacaatacaggaatatgcaaatttttcaaaaaatcctccagccactgtaaagtttgaatatcaagatcattggttggctcatccagcagaagcagctttggcttacgcagcattagcttcaacagctgcagcttcaccttctctccaccgcttaatgttcctatcctctgttctccatacaaaagttcattttttaaacccagctgtgcgcacagtgtttcacagccctgcagatcattgtatcgttccggctggatttcatcttcacttttttccttcaataaataatcaaaaagaaaagcatcctcccattgactggaaagctgctgttcaaaatatccgatttctttataatctgtatcaatttcaccactcacagttgcatagtcttcaattagatttcggttataaaccgcctttagcagtgtggattttccattcccttcctcgccgataattcctaccttatcgtcatttcccagggaataatttaaatcgttaatcagtgtgtgatgtttactatcacggatagtaaggtgctttagaataagcatgagcatcgcctccttttaagcaggctgtaagcagataattgacacatacgaaaaaagtttattttaaacagttcgtttgctgggtctcttatctatttgctcatcttctcactctccattcctctctattctactatcgtatgaatttactgtcaagcccaaaagtgattttctcaggactaaatgaaaaagtgttttgattctgtaacccatatgatagaaatgccttagactctgaaaaaaaacatatagatcatatggtatgaacgcattaagggataaggccttatgacacggaaagaaaaagagatttcttcagctgatttcccggctgttcaaaatcccgttattcttcttcaaaaagatatctggtttcaggtatgttatattattaagctatgcgccttttttcccattctgcttttgtgacatacaggatatgctctgtaagtgtctgctgaatcagtggccattcccttacctcactgcgtaaataatggaagccgcatttctcctgtacacgtttggatttttcattaccgtcgaaatatccgcaccataatgtttttaactgacagtcctcaaatccaaagcgcataagctccttcaccgcttccggtatcagcccctgaccccagtacggttctccgatccaatagccgatttctccttcatcatccgcaatcgccagattactctgcttaccaatcatcagtccgatgcttcccacaggctccatggtttccttcagcacaacggcaaaggtattcggcgcagacagcactgtccgtatgatttcccggctgttttccacactatcatgcaccggccatcccgctttgggcccgatgtttggatttttcgcataccgatagcagctttccgcatcctcaacctgccatggtcgaagaatgagtcgttttgtttccagcataatctccctcttttctgtaattctctatattatatcaaatatccttttattagcaagaaaaataaggcaatacaacagcccgctgaagtgaaaagttaaattccactttcaaagtagccaagtagaaaagactcttacacaacaatctagttgaatttacacttacaattgcatttagtctttcatatatccttttttatatctatgatgaaggtaaccgctggttattatcatacacattacaaagggtgatgaatatggcaacgaacaaaaacaaacatctgactcaggacgatcgcaatgtcatcgcgatcggcatcgttaatggttcttctaaaaaagctattgctgataatctaggcaaagataaatctacgataggtaaggaaatccgtgctcaccgttatctctctcataaatctacactttctctagaatgtgagaactatgctcactgtaagtttaagagaaagaattgtactgtcaactgccctgattattctaagttccgctgcaaacgcagagatcgtactccgggagcttgtaatggctgtgagaaactgaaaagctgccgctttgataaatacctctataaacctacgatcgcctatgaggaataccgtagcgaactcgttgagtctcgaaccggaatcaatctgacctcatcagaagctgtagagctaggcaataccatcaagcctcttatattaaaaggtcattcaccttatcagatcatagctgcacatcccgaacttggaatcagtgagaagacactctacaactatattgaacaaggtgtattcgaatgtgttggcattgctaatattgaccttcgtataaaagtcaaaagaaaaatgaccgctaagaagaagacgatctataaaaaacgacaagaccgtaaattccttgttggacggctttacacagattaccaatcctatgttgagtctgaggaaatcactcacattttacaaatggatacagtctacaatgacatttccaatggaccgtttatccagactttcaaattcatcaaatatgggctcctgtttgctgtatatcacgacacgaagactgctgcagatatggttgacggactagctgttcttgattccatccttggaaaaagcctgtttgaacaggaagctcatataacactcaccgatcgcggaggtgaatttactgatgctgagcatatggaaaaaagagacgatggtaccagaaggacacgagtcttctattgcgaccctatgcagtccgggcagaaaggaagcctggaaaatatgcatcgtgaattacgttatatattacctaacgaagtagacttacgcagtatcggcctgaccgatcagacttccttgaatgtagccatctcacatatcaattccagtgccaaggaacatttgaatggaaaatccccatttgagctatgtgagttcatgtgtccggaattagcgcagaaactttatgaatttggtctacagaaaatagataaggacgaagtgatacttcgtccaagcgtattgactcataagtaacaaacagatgatataaagaatgataagagcagcggcaaagaacagttatttatagtgtaactataaaatagaagtggaatttagttatacataggcataatggagcctattttcagtgcgcttattcattttatctatcattcgcacaatgaccactttcttcacatttttacttacttctacctatttgaaaccctttctaacgctatatttatgctctgtatagacttttgtagaagaaagttccacattttttattcgccttttgaaagtggaatttaacttttcacttcagcaatacaacagcccttacgcatccatctgtattatgtattcatgcaagagataccttcctatattttcagatgacttataggaagaaatgagcggaaataagaatttccttcaagggatatattcagatgtgggattctttttctatattcagcttcatttccgctatcaatttttcacttcctgctttgtttaatcagtacctttgttttaggtgattccgaagcctattagcagggcttgttatcgctcagcgctaacgcatgcaaaacaaggatacacctgcagcttccataaaatcgaggaattcaaaagccggtgccttctatcctatattgcctgcatacgctgcatatctgttacagcatgtcctgatgcctgctattctctgagaatttcacgggtattaaaatcattcagactgtgaaaatgaaggctctcgtttcgaagcagataaggaaaacctattgcggtctgtttttactagcaatttgaatcctgcagcctgccataaatataaagacatattccattccgctgctgaacagccctttgaaaaatgtcaaatattctctttaaacaatatataaagcatgcttaattagtttccgtgccggtagaatgtttccattcctctatggtaagactcataatatgcccggtaagtgttttttgaagcaacggccattctcttacctctgaccctgcataatgaaagccgcatttctcctgtacacgtctggaattatgatttccttcaaaggaaccgcaccacagttttttcaaacagcagtcttcaaaggcatatcgtatcagacattgaactgcctccggaataaatccctgtccccagtacggttcccccagccagtagccgatttcaccctcatcagctgcatttgtcagattacactgctttccgatcattaaactgatattgccaatgggctccatattctgcttcagcacaacggcaaaggtattcggtgcagacagcacagtccgtatgatttcccggctgttttccacactttcatgcaccggccatcccgctttgggcccgatgtttggatttttcgcataccgatagcagctttccgcatcctcaacctgccatggtcgaaggataagtcgttttgtttccagcataatctccctcttttctataattctctatattataccagattcctttttaatgacaagcaatcggcagaaggaacagacacagaaagagctgctatgagaattcataccaaataacaaagcacacgtaactttgacattcataatattcattggtagcctttgtttaattgtatatttcaaaaaatagacagcggaagataaggagattcttacataaccgtggtaaattcaaactatggagaattcaacatacttatatttatcaacagaattcatagtctccctttgtaaatgcctgaaagtaagaaaaatacgataagaacacctgtttgttcagataaaggaagctgctacttcagccgaaattgctcaatccgttcgattgcagaaatcagggcattgcgaaaaccaagacgctccagctctgcaactccctgaatcgtcgttcccttcggagagcttacgcgatccttcagctgtcccggatgctgtggatgaaccagtagctgctttgcagtgccagccatcatctgcgcacaaagccggtaagcagcctcacgtccaagcccatatgccactgcgccatcccccagcgcttctataaacatggccgcaaaggcaggaccgcagcctgccacggttgcaccaattgtcatttgatcactttccagcttttctatgaaggcaatcgcggagaaaagctgttcaacggccacagcctcctctgtttgcagagaattcctttgttcccataacatgacaccttcacaaacggataccggcatattggggatcacgctcaaatgttgtgtatgtggtggaagcagttgttcatacgtttcaaagaacataccggccgcaatagaaactacggcttttccctgcaggtgctctttcactgtggaaatcgcctcactcatctgtgcaggcttcactgcgagcaggatgatgtcacactgccgtaccatatcaattgcatgtttgcatgcatgcatcccacgcacttctgtatttctgcacagcttatcccattgcctggcacaggcatacagctgctctccctttacaattccactcgcaagcattccatctgccatggcctgtgccatatttccaaatccgataaatcctatgttttgtttcaaattcatcacctctgtatatcgtatgcagaaaacgacagctgtgcactgtcgtttggtaaattctgaattttatatcagttatttcatccaccgcttcagtgttggaaaatactgcgtcatcatttcccgcgctttatcttcactcatccccggattttccttaaccatgacaggaacacagaattcaatcatttcctccattgtacaatctgatgtaaatgcaccatgttcataacagtatttacaatagtccacagaccttgatccgtccttttccgttccatataactcctttgtatctcccattggcattccacagcactgacaatatctctcttccatgatatgtcctcctttatatgcccacatgatatcatgagaaatatgacagcagcctgtcctattccaaaagaaatgactctatttttcttttttcatatagaaatttgtcaacagctgtccctgccgctccacctgctgtgcataaatcagccgatagccacgctgcaggaaaaaattccttgccgttatcgatgcatgcactgaaagagtaggtgatgaggtttccgtttccagcaaatcgcaaagcatcgtggcgattccctgcttctgatgctgatggtgaacatagaggtgatccagataaccggtttcatccatatccgcaaatcctaccattttctgattgcttgtggcaacaagagtggtatgcgccaacagcgcacttttcattcgcttctccttgacacccagtacccaggccgaaatctgttcagtcgtataatccctgctgttaatatttctcacggtatcataaaacagccgcagcacctctgcaaaatctttttcttgaaatgtacgcagctttacatgatttctgctttccatacactgactcctttcttataccgggctgtattgcacagattcagcctcatttcaaatctgttatctaatatgcatcctttttttatggtatctatcggatatattcaaaagcttagcagattctaatagaaaagtacaggagccgatgcgaggaaaaggcatgcaaatatataaagaatcatggaaaacatagcaatcataattcttataaacgtattgaatgcattatttcctgttctgccttacatactgcaataggaaaaacagcagtcccattcctgcgatgatcaggatatgatccagtgtatcggtcgtatgtccgccatagctgtagacaaggccaaactgctttttgaatgcagtcaaatgctccggcggtattgactgaaaggttttcgttaagacatcatccatcatgatattgcgaaacaacgcggcacaatgactcggtggaaacagcgatatcacggtttgaagcagcttgggaagtgctcctaccggcacataaatccccatgagaaatccggatagtgtgccgataatggtcgtgacattgctgaaggatgttgcacttttaaaaaatgacatgaagaaaaaaagcattgccgtacaggccaggatagacagcaccatgcatgcaagcacctttaacagtgcggacagtgttaagaaggagcctccataagcaacgatataaagctctccgattatcaacgttacaacggataccagaaatgttatacatatggtagagatgagataggcaccggtgaccttcatttgcgaaatgggcgcaatataaaagtcattgagtatggacctgcttttatcctcgataataattccaagtacacttaaagaggttgtcagcgaaacaattcccagagttcctgccatgatccaggtatcactcagttctcttgccgtatccgggaaatcctgctttaacggctggatcatcatgtcacctagaaagcatacatacagtcccagtacaacaaatactgccataaaggaaaaaaataccgaagtcttatccttgaaaaacagcagcatattccgttttattaaagaaatcatacctgttcctcctgaagcatttgcagataaagttcttcaatattaccgggatggttttcaaagcgctgaatatagcgttcgcagaggcgcaggacagacatcgttttcagcatgcctcccgtgtgtatgcagagagcctcgttttgctcatgaaatggtatatggtgtcggtttagttctgcaatcagctgtgctttactggccggataaagcagcagctgctctgcggcatactgtttatgtacctccttcataggcttatcaaagatgatgtttccctgcttgataatgcataaatgatcagcaatttcagcctcttccatataatgtgtggtcataaatacggtcatatgacgttccttatgcaatgcgctgattgtgtcccacagctgctttctcgccttggggtcaagaccggtgctcggttcatccaatatgagtatttccggttccggaatcagtgctctggctatatcgcagcgtcttcgctgaccgccggaaagggttcctaccggctgatgcataatatcgtgcagatcacatatgtcacatagcttctgtacacgccggcacgcctgtttatacggcagatgatagagggcactgcgcagaatcagattctgtttgactgacagcaactcatcaaggacactgttctgaaagacgatgccgatacctgatcgaatacgttcatcctcctgtcccaaacggaagccattgattataaccgtcccgctgtcctttttcagcaaggtgctgagaatggagatcgttgtggattttcctgcgccgtttggacccagaaaggcaaagatttcccctttattcacctgaaagctgatgtttttgacaaccgttgttccctgataggatttacagagctgctcaacgcggatacttgtctccatgatattccccctttacaaaatgcatgcttcagtgcagtatatgcaaatcaagagggagatatttcacagaatacatgcggtaacagtggtgtcttaggctacatgaattatcgactataacagagcaaggagaaaattgctggttttcagaacatcttatccatcaaatggaagacacaaggttctgcaggagaagagaaaacggcctaagtcctttatgtaagtgacataagccatgttttcccataaccgatttttaaagacagtctaggggtacatagatatatggtcttctgccttttaccacatggatttgcaattacatgcagttctccacatattcaatgccatgctcctggcaccatgcaattgccagatttctgtaataatctgcctgaaaatcataccattgcttagtaattccccttctgtttaccatatccttgaatcttcgaaacgctccacgtccctgtatgacttgttccagtttatcagcatcttcaccttttaatgtctgaataaactcttccataatattatactcatggatttcaaattttgttggaagcctaaaaaaacgctcagggttatcttcaatttcattttccaacccctcattatccataccggtacttaattcatcagcaagcagcacactttttccagtttctaaatctaaaaaaaatgtaaaattatcatctgccatttcaatcgcttctataatggtacttatattaatcttcatcttgacattctcctattccattttaaatgtgttttctattccatatcgagcataacataattttttattaaaatacaaatgaaagcagtatttttgaatagacataaataaaaaaaagccttttttatcaggctttaactccacatacagtaaaataaaggccttatacaacatgacaaaagtattttcattacataatggtggagtaaatttattcgttaaaattcacggggattctccactcgcataggcaagcgataatgtgtcctactccactatccgtattgatatgttccatgccctgatttacaagcattatcgtgatttcaatgtactcaaaaattacaatctatttttgaaacaacctattttcaagcctttttcacatgttacttctgaacccttgacatcaagacaacactctcaacgtgactcgaacgattaaaagagataagcaatgtgtatagtaatcccttgttgaaaatattagattaagcttcacaaatatcataggtatattatttctatctgctaataattccgctaaaagttgaagatttacccattatcgagtaaaacttttttaatatacaacttcatcttctctgataatcgaatggtatttttcagaaatttcatcaaaacaatccttacaaagatcaccagataacactccatcttctttattgctaaaaatatcataatactcgctacactcatctaatacatcataaagaccatataaatcatttgttttctttaaacatctagcacatctacatccatcaaaacatccaatcgcttcatacgtatttccatcacaataatgtacagcatttcttgtggtgtataataaatctttcgcaacactaaattcaaatttcccttcatcatacaactctaatacctttttagacactgaatttaatccatgcccaatactatgacaactcatatttttagctccttattttttttattatcactaatctaaatatatcatatttttttattttactacaatgctttattataaaactgtatgatcttctttggtaaagcatttagtttttttcaagtatacaaattctttactaatctgaaataaggataaacatcatttttcatttattactttcattgatactaaaaattagtttattttctaaacctctactcttccaatatgttcaaagtcttcatcaaaatttctactatttttttcttgcgcaataatttcatttacatcattctcttttaatgttattgaataagggcatttacctcttcctttatccattcttgttgcacatctataaacaatctcacctctctcagttcttcttctatatggtgctccacaatatccacagacaagcacattagaataaatcgacttacttctgtattgattatgtcttattactttgtttcctttttcatcaaaaatacatcttgatctcatcttcttaaatttttgaaccttttcaaaatattcttttgaaatcatgattattcttaatatagactttttcgatttgtccaatatttgcttcccttttcccagtcaaagcatctgatacaaatgttttttgttgaaatacatttccaatatatttttcatttgatagtagattgtttattgttttgcaatcccatttatcttttcctgatggtgatttaatattgaaattttctaatagttcttttatttgcttcaaagttcttcctcttaaatattcatgaagaattcactttactacattggcttctttatcaaatatggttaattcattattaatttttctatatccatacactgtcttcacaggtaattcacctcgtttcatctttactctcatgccctatttcacatttatacttttcgaaagagtctgctcttgctgtatctattttctctttatcaaaatacacattatgtttacgtagttccctcacatctttcaaaatatccaatgtatttcttgcaaacttactaactgattttgtaataatgtaatcaaatttgccttctaatccatcttcgatcatttttttatagcttgttcttccattctttcttaacccgcttcttccaacatcgtaatacacttcaacttaatcgatttctattactttattagaaagttctttaaaatatgcaatttgaatatttaaactcgaacgttgttcttctacatttttacttactctacaatatactgcaattcttactacttctttctttttatttttaactggtatcttctctacatgtatcattttttattatccttatcactccaatcttaacatatgaaaaagatgcaagttatcatcaacaacttacatctctataaaactgatttaattttttatctttttcgcaacagaacaatggactcaacatggcttgagcgggtagtcttgatagcaatcttggagcctaaccgctcattatagtgggtaataagtccaccaaatccactgattattaacgaacaagtcaatgcctaaatccctagaaaattcctgtatttcagtaaataggtcaaaggagatttatggctttttcatagttctgggcgttctccagttagcaatcggtcaacagcatttggggaattgaggtctgttcataggggaaccggcaacttaatttctattgtttcttcaataatttaatgtcaaatttaccgcccaatgccgctgtgcctattccgaccgctgtcattaaaacaaaacttgcagcactaatgatcttccagttaaactctttcttttcagtgtccttcttgtcagccatgcaagcagatttcatttcctgctctcgtatctcggtatcttttttatctaccgcatgaaaaatttccatttggcggtcaataacatccttctgttgttctggagtcaaattaggattatcaagacacttacttaaatctgcacgtactttatcagcatattcaatgaactctcttctgctttcagatgcggcatcaatttctttatttaaaatggcataaacctgtttagtgctttcatcatcacttgcaacaattttttcaagaatgccttgatactcgaccattgtcgcttgaattaattttgccagttcgggaaattgagcaagtacctgctgtgctacttctgggcgaagttcgttcagttttgatgcataacttaatatatcaatttttgataaatttttaaaatctgtcctatccataagtgagagaacgtgtttttcattgtttgtatattccatcctattttctcctaacttcatattaagcatccataaccttgaactgttcgaaattaccgaacagttcaacggagcagttactcaaattttccgaacaacttacttttgttgtttccctttttgttccagtaactttatactttccaaatagtccttttccacactgctaagtgtttttgccttatactttttatactccgtcttagccttttccatcgcctgtaaatgactaaccgtgccatttccagtgagaagattttctcctgtagaagtcaaaatcccgtccagatgctttgcccaatcctccattgtcataggcacttctcgttctgcctgtctttcagcaaaatccaaataccccgaaaccagttgacccattgaacgcagttctttctcatccaaataattctttgcaattttcgcttcctttaaagtcggttgttctcctgaaaatgacatcaatcccatgaagtctttttcggcatccgcacgatgatagattacctctgccgctgtttctccggaaacagcatagtgaattttattctgcactttcttaaaaaactgaatagaaacctctgctttgggatcatagtcaatgcttgttgcatagatttctaatacctgacgataaaataccttttctgatgcccggatatcacgaatccgttccagcagttctttgaaatatccgccaccgcccagttcctttaggcggttatcatccattgtaaatcccttaatcatatattctttcaagcgttctgttgcccatcgtctaaaattagttgcaatggaagattttactctgtatccaagggaaataatcatatcaaggttgtaaaacggcatctctcttgcaacttcacgatttccttctttccgaacttgtcggaatttccgacaggttgaattttcatcaagctcaccttcatcataaatatgttttatgtgttccacaacattagtacgagatgtccgaaataaatctgccatctgttgctgtgtaagccacaccgtttcatcctggactttaacctcaatatttgttaatccatcatcagactgatatataagaatttctccataattatccactgtggtgtcctcctaatcctctcgctttacataggttagttcaatatcatacccaagggcttccagcatttgtacaaaggtcttgttcacaacaccatcttgctttttgatgatgcggttgacatacgggcttgttgttttaatcttctctgcaagctgtgcctgcgtcataccgctttctatacattttacttttacgtctacttctatattatttttcagcatttaaatctcctctgtctgcattccctttactaaattacacaaatcagataatttattataccatacttctttagctttttcaatgcattccaaaaaagtattatttcgggcttgtttttttaaattattacgataacatttataaattcatattgtaaaacaactttaattgttcgatggtataggtgtaattctgaacttgaacctatttgacaaggtgataaaactctctacaaatgcttttgcagaacaaattcttcatatgcataaagtgactataaaataaaaccatttatttccaacaaaaaagtcgcagattttctggagtataaaaaatctacgactctctattatttgtgaatcacaatctaattttagctattttcaacatccttcaaaatcttaccctcatccgttctccattcgatatttccgtttgctgatgcaccaagtacaaaagcagctgaacttgatggcgatttgaataatatctcgtttttaataatactattctcgtctatattatccttattgtttttcctctcagttttcacataatctgggcaacttggaacaatatctgctctaattttgctaccagctaaaacaacaaaaccttcactagttaacttgccctttgcatctgcaccgctacgtcttatataaaaaatcttattatcgctttctgcactatcgctatttggagcaaccattgttttagagtctgtaaggggttcaaacaccttatgcccgagcgtacccataattatttttgcataatcaatgaattcctcgagttcgctttccttttcctctgtaatgttgccgggtgtagggtcattaccatttttcacaacataacgttctgtctctttagctatatttgtaaatctattttcaagatagcttatctctgtgggtccgaaagagttatttgaagtggtaaacaccacagtttccgtccagtaatctttctcaggattgcgtttatgctcttgcaagcgatatagtatcccttcgccatttttacgaacgccagcctgtccaatataaactacattttcacctgtttgatcagatataccaaagagaaaatacacaccactttgcgaaaggtcatcacgtcccttacagctatcaagctttgttcgtgggattttataagcaactcctgtccaattagcaagagtgcatttcattctgccatttggttctccatccatcaaaaataaatttatacttttccctcgcatatcttttcaaacctcttttcatctattctcttacatacgtttttgtgtctctgattgctgtcaataatcccacacactcgcactatgccagcagtcctaaacactcaccaatccataattgaataataagtcatagggcagattacaaaattccaccaagtcatttctgcaatctcgccccgcttttaaaatttaccgctcggttgctcactgcaccgacttccgataaatgcccattttatcgctttttcggcactttttctacttgtttcgggtgagcaaacaaacgcactcaacatgatgcgtgaacggaaacatatccagaggctgcacaatttctgtacgataccccttctcctccagcagctttaaatcccttgccagtgtcccgggatcacaggacacataaacaatccgttttggctgcatcatcaccatactgtcaatcgtctgcgcatcacaccccttgcgcggcggatctaccacaatcacatccggatgtgccccctgctcacacagctttttcgcatagtcagccgcatcgctgcacacaaactcaatattcgcaatgccatttaatgccgcattctttctcgcatcacgaatcgcctgcggtacaatttcaattcccgttacatgttttgcccgctgtgctaaaaacatagaaatcgtcccgactccacaatacagatccagcaccgtttcctttcccgtaagctttgcaaactccagagcctttccatataatatctccgtctgtcttggattcacctgataaaaggactttgaggatatggaaaacttcaaatcatgaatactgtcagtgatagcacgctccccaaacagcagctgttccttatcccccaaaatgacattatcatcccgtacattcagatttaatatgacactcttcacaaacggtaatgccgcagtcagctcctgcaccatctccttcccatgtggaatttgaaaggaacgcacaatccagacaaccattacctcatcactggaaaatgcatgcttgatcaacagatgacgaaacagcttcgcattctgatacttctcaaataatttacgcatttcctgtaataccgcattgattcgttcactctgaatcagacacgtatccgtatcaatgatggcattggaattgatacgataaaagccagtaaccgttttacctttctcaactccgaccggaatctgccctttgttgcgataattggtatagcaatcctgcatccccagcacatcccacacctcaatatcaaggtgtgctatccgctgcatcacatcctgcaccttctgcttcttaaaccgcagctgctccgcataggacatatgctgaagctgacagcctccgcactgctttgcaatcggacagggtggagcaacacgctgtgaggatgttttacttctcttcatcagcctgccatagccaaatttcttttttgccatcgtgacaaccagctctcccgcttccccctccagcatgcccttcacaaacagcggaaagccgtctatctttacaaccccgtgcccgtcgtgcgtatatccgctgcagacaccatatacctgatcatttctcttcatcttctcacctcattgaaaaaagggcaggccgcccttttacttgtttttcttagctgcttcttcctgctgctttaacagcttttctgcgacggatttatttttcggagatgaaggtgtagaaacattcggcttcttcgctgccgctgtcttcgtcttgatcttataaatctgatcatccgcagaatgcttgtcatccggaatgaaattataaacatgcacttccagatcatacatcttatcggaatcgttatttgtaaaatacttcttgataggaagaatatcattcaccttatcataggcttcattcataatactcttcaccttggcactgctggcatcatcctttgtatcaatattgatacgcaaggtagcactgatcaaattgacttcaacgctttcaacaccatccagcttcattgcggacttcaccttgtccatctgttcttctgttatggccggattcagtgaattgtcaaaacggctgccgaccgtaggacttccgctgctctccttggcactcagataaatccatccaagcagcagtacaggaatcagaataacaataccggcaatccagtatagtatcttgctctttccgccgcctgcttttgtttttttcttctttttactcatggggttcactcctgactatatagacaatgagcatactccttaggagtcatgcctgattacacgattgtgtttctagtatagcacatttaccagtataacacaaaaccgcgagaattacagcgggaatcttcttacgatttcctaaaattgacagcttcacagacaggctttttcaaaagctaccctgcaatatataagccggtgtttcgcatagcatccgtgccttacgctcgcaggcttcatcaccggctggcgcaacagaatgctagcgctttttcaactcctcctgaatcagcttattcgtcatcgccggattcgcctgtcccttgctggccttcattacctgaccaaccaggaagccgacagcacggtccttaccgtttttgaaatcttcaatggattgcgggttgttatccagaacagcgctaaccatggcaagcagctcactgctgtcactcatctgcttcatacccttttcttccacgaccttcttcggatccttgccctgcatgatgtcctcaaacacgatttttgcctgcttgccgctgatttcaccggcatccaccatatttaccatatccgcaagatgctttggattacacggattatccaccagcttgatatttgccttattcaatgcagctgtaacctcaacgatcacccagtttgctgccttcttatagttctttgtatactgacatacctcatcgaaaaagttgctcagctcacgattggcaacgagtacatcagcatcgtattccttcagtgcataatcgtgcatatagcgtgccttacgctcatccggaagctcctccatattatcctgaatgtctttgatccatgccgcatccagacgaatcggtggaatattcggttccgggaagaacttgtagtccacatttccttcctttttccgcatcagaatcgttgttttctgcgtttcatcataacgacgggttgcctgtacgacttcctcaccgttttccagcagctccctttgacgtgccacctctgcatcaatcgccttctgtacattggaaatggaattcagatttttgacctcggttttggtaccaagagcttcactgccctgcggacgtatggaaacattgacatcacagcgcatgcttccctcttccattttaacatcactgactccaaggtaatacagcatacttctcagcttttccacataggcagctgcctctgccccgtttcggatatccggttcactgacgatttccaccagcggtgttcccgcacggttgtagtctaccagtgtccccgcatcgctgtgaaactgcttagcggtatcctcttccatatgaatacggttgatgcggatatccttttccccgtcatccgttttaatggtaatgacaccgttggagccgattggatgaaactgctgggttatctggaagcccttaggaagatcggaataataatagttcttgcgatcaaacttcaccagcggatcgatttcacacttcaatgccgttgcggccagaattgccagacgcacagcatccttatttacacaggggagtgttccgggatgtcccagatccacttcatttacacaggtgttcgctacctctccaaaggatgtcggtgcccctgagaacatttttgttttggttttcagctcgcagtggatttcaatccctatgactgtttcgtatttcatgcgtctacctccacatcattaccttttaatcctgtttcctcttcaatcgccagtccgatattaaacaatgtctgctcatcaaatgccttcgccgtcatattgataccgatcggcataccttccgcaaagccggtcggcatggtcatgctcggatatccggagaaattgcccagcaccatatgattttcagccacattgttatctgccccaagatgagaatccttggattcctctgccagcggcgcgattgttcctgcagcagaggcaatgacaacatcgctgttggcaagaacacggttcagctcctccacaatcaggcggcgaaccttctgcgccttgcggaagatcttatcctgattttccacaaacagagaatagcttccgatgacaaaacgcttgcgtacataggaacagaagccctttgtccgggtgttgatcatgacatcctccacgttttctccagcctcacgcataccaaaacggattccatccagattggaatggttggctgtagcctcggcattcgcaataatatagtaggtaggcatcagtgccttcatcagcttatcatccatgcgcacatgtgtaacagtagcaccgcgtgcctccagcttcttcatcaaagtgtcaaaattctcacggattgcaggatccgcaaccgcctcctgtacattatccaaaacagcaatgcgctttccgcgaaggtcatgattcaggttggcagcataggcctccactgcacggttggatgaggtcatgtcacggtcatcgcgaccagccagcacctccagtgcaaccgctgtatcctgtacggatgtggtaaaataacccacatgatccagactggatgcatacggaatgataccatagcgggagattcttccataggttggcttcatgccgataatcccctggtatgcggccggcttgcgcacactgtcaccggtatccgtaccaatggcaaacggaacgactccagccgctacaagtgctgcactgccgccgctgcttcctccggaaattctgctttcatcccaggcattgttaactggtcctgtgtacgcattgcggttggttccgcccatgcccagctcatccatactggcctttgctattacaactgcgcctgcagcttgcagcttatcaacgatatgcgcattgtataccgggatataattatccagaatgcgggaggatgccgtggtacggattcccttcgtattcacgttgtcctttaaaacaactggcatgccatacatcgctgcatctgcgccgattgcttccagctccttcagctgctctttcgggtctacaaaggtaacagcagcatttaaacgcgcctgtgcttccttcgctttttccaaagcctcgtaaacgcggccctccacgtcctgctttctcgctctttcaaaatccattttacttcaccacctttggcacatgtacatgccctgcttttgcacttttcacattcagaagcgcggcttcctgtgatattacattatctacgctgtcctcacgcagaaatgtcgtttctgcttcaaacgggtagatcatttcttcaacaccctctgtatcaatgccatccagcagctcgatctgctgcagcaaaaccttaaattcctcctgcagctcactgacctcttcatcattcagatcaaacatgatgtcatgtgccagcttcttgaaatattctgcactaaattcttccatgattgcctccattccttcgccttgcgcgattcagatttctgaaaaagagaatgcgttttgttcgataccgtcacatctcttttcgatcttcccttttatttataccgttgcatgaaattcttgaaaaggcgtagctacctgttccttcgaaattcattttattcttcttttctatttccggattaatacagcagtgtctgtgcaaccgtactgctggtacccttgtttctcgtaatggtggcgacatctacatcatccgccttgactacgaccgtgattttaaaattattgctggaaaagatggaaagccgctcatccagcagctgcaccgccgcaatgacctcatccgcactcttggcatgcagcttcacattgatgcgcagatctgtcagctcattatccatgaaatgacctttaccgatcatgtcgatatcctgtcccagaaaatcctgaaagctcgccttgtagcggtcgaaataggttgcgtttgtcccgtccagcttggttgccgtgcttgtcggaaacaatgcccatttctcattgatcgccttgaattccgcattggtcttggattcaaaataggcttcctcaaagtacgttcccggcagcgtcgcatcatcgctggaggtattatacagcgctacataaatcggtgtgttgtttccgatttccggctttgcctttcgcagataattaaccagcttacgcgcacattcctcgccatacagcttcattttgtcgctgtcgatggttgcctcctttggttccgtaccgattttatcattgaatacgagcgccagtgacagccccttcagctccttgttctgataccagtcatattcaaagatatccagcagcagcacatcattggctgttatttttttatccccgtcatcggttggaaatacatcaccgactgcaggatttaaaccgtttgcatttttcttgctcgttctccccagcagtccgctgttatccgcggaggcatccagtgtattgtaatccagatattttccacctcgaaaggcataggtcttacttgaaaaatattccttggaaagctccatcaaaccggtaccgatggtcagggtatcactcagattggtttgcatctgggcatgcttctgccccgcatcactcactgaaaacggcagcagtgcagagtattccccttcgttgatggcctttgtttcctcactgcttttatcattgtccgccttgtttttatcttccttattacagccgccgagtaccagcatacagctgcaaagaagcagaatcggtactgctctaggtttcctgttcatttccgttcacctctttcataaaggtatcctcatccatcgtcatgacaccgagggaattcgctttggtcagcttgctgccggccgcctcgccgtaaatgacaaggtcggtttttttggaaacagagccgctgacattggccccgagagattccagcaacgccttggcatcatttcgtgtcatctgcgtcagcgtaccggtcagtacgatggttttgccgctgaatgagctttcctgaatctgctcagcctcggtatccatccgcagaccatagccctttaaatgggcaatcagctccatattcttcggctcatggaaaaaggcggtgatgctctctgccgtaatctgtccgatatccttgattgccacaagctcttcctcattcgctgccatcagtgcatccatgctcagaaaatgctttgccagaacctttgcggctttcttgccgacctggcggatgcccagtccatagatcagatcctccagcggattctgcttgctgtcctcaatggcatccagcagcttatctaccgacttttctttaaagccctccagatcgatcagctcctgccgatgctccttcaggcagtatatatcttcaatggtattcaaaaagccctgcttatggaaaaattccactttcttatcacccagtgtatcgatatccatcgcatcccgactcgcaaaatgaatcatgctttccacaacacgggcggggcagtcctgattgatgcagtaatgggcagcttcctcaggaaagcgtaccagctcacttccgcagatcgggcagtgcgttggaaagtggtaaaccgcctgcgtatcgtttcttcgctcaagcagcggtcgaacgacctccggtatgatatctccggccttgcgtaccacgacatcatcatgaatacggatgtccttttccttaatcatatcctcattgtgcagctgtgccgccgataccgttgtacccgcaacccgcaccggctccagtacggcattcggagtaatacgtcccgttcttccaaccgttaccacgatatccagcagctttgtgataacctcttcggcaggaaatttatatgcaatcgcccagcgcggcaccttgaccgtggagcccagacgattttgtgcgtccagatcatccaccttgatgaccataccgtcaatcgcgtagggcagatcatttcgctgctctgtaatttcttcgataaactgccacacctcatcgatgcgctcacacaccttacgaagcggattcacccgcagatgcatttcactcatcttctgcagtgcctcttcatgggaatgaatatcgtattcctgtgcattcacaaagtaataccagaaggcatccagcttacgctttgccgcaaccgagctgtccagctgacggatacttcccgccgccgcatttcgcggattcgcaaacagttcttccccgttcttttcccgttcctcattcagcatctgaaagctggcattgggcatatacacctctccgcgcacttccacctcaccctgtagcgggatatgcatcggaatggatgggattgttttgacattgtgcgtaacatcctcaccgacaaccccatctccgcgggtcagtgcctgtacaaagcgcccgtcgcgataaatcagggacatggcaagtccgtcaattttcagctccaccacatagcgtgcgtttggcaccacttcccgcacacgctcgtcaaaggcatgcagatcctccagattgaaggcattgcccagactcagcatggtgcgcttatgctccaccttcgtgaatgcatccagtacgacaccgccaacgcgctgcgtaatggaattggggtcgcggtactgtgggaattcatcctccagtgccaccagctcctgataatagcggtcatattcctgatcgcttttacttggctgatccagtacgtaatattcgtacgccagcctgtccaatatacttcgtaattctaaaatcctctgctgactcattagaaacctcctattttttcgataaagccggatggtcgatcttgatctttcggattccgaatttctgttcgaaggctatcgttgccagctgttcctccagcttgatgacaacgccgtctccgaagctttcgtgatgaaccagatcgccttttcttattttaccctttttcttaggtttcctatcctcatttatgattggtgctccgtcaaatgaatctgcaatgcgtacatcgcttaattttcgctcggcctgtcttgcatagccgctgctttcctgaggacgatgctgtaccatgtcactgctgtgcatggacagaaagtcactgccgctgaaggtatcgacatcgctggaaaatgtattccgcggttttgcgccgacatcctcgatacagtcctcgggaagctccttgatgaaccgggaggttgttttgattttatccagtacatagctgtagccgtaggagtcggataaaaacagctgttttttagcccgtgtaaaggcaacataggcaagacggcgttcttcctccagcgccggttgtccgccttctcccacagagcgttcattcgggaagattccctcgcacaggctgtacacaaagacattatcaaattccagaccctttgcggcatgaatcgtcatcagctgtacaaagtccccgttctcctgttcctccttatcggaatacagggagatttcctgcaggtattcattcagggtaccctccggatgtgcttccacataatccgagatatccccgatcagttccttgatattttccagacgctcgatttccttgtcttcccgcagcatatccagataaccgctgtcctccagcaccttctccagcagctgatcgatgctgatagtatccaccagcatgcggcattcctcaatcatcgcaacaaacgcctgtatgttggctcttgccttgccctttccgatttcatattcgcacaggacatcatacatattcgtttcatcatggtttgcctgcagctcgatggtttccagcgtctttgcaccgattcctcgcttcggagaattgatgacgcgcttgacggcaagatttttgtacagcgccttgggatcctgttcatcaaagggagccaacagacgcagatagcttaaggcatccttgatctccgcacggtcatagaagcgcacacctccatagatgcgatacggaatatggaaatccagcagcactttttccagacctcttgacagaaagttggagcgatacaaaatcgcaatatcccgatagtcaacatgatcgtgatgcagcgtcatgattttgctggcaacccagaccggttcgtttgcatcatccatagcagagaaatgaatgattttatcctcactctccacacgggtgaacaaatccttatcgatacggttgcggttattcttgatcagtgcattcgcaccgttcagaatctgctgggtggaacggtagttctcattcagcacaacggtatggctgtccggaaaatccctttcaaaattcataatgatatccacctgtgcaccacgccaggtataaatcgtctgatcgggatcgccgaccacgcacagatagctgccttcctttaccagcagcttgatgatggcatactgcagattatcgacatcctgaaactcatcgacatgcagatacgtgaagcggcgctgccattttgcgcgtacctcttccttgcttttcaatatacggtgggcaaaaatcagcagatcatcgaaatccagcgcatacatttccttcaggcgcttctcgtaaaactcgtagacatcggccttgatctgttcacccgcccatttgccggcacccgccttggctgttgcggcatcaataaaattcgttttgttgttgcttatgtacgacagcacactgttgtagctgtagcttttgacatcgatatgcatctgcttgtaggcatcccgcaaaatgctcttttggtcatccgcatccagaatcgtgaaattcctcggatatcccagctccagaatgtcctcccgcaacagacgcacacaaaaggagtgaatggtggaaatcgtaaccgccttggctacatctcccagcagattttccactcgctctttcatttctctagccgccttattcgtaaaggtgatggctaatactttattcggatatactccgcagtcattgatcagatatgcaattctggtcgttaccacccgggtctttccacttcctgcccccgcaatgatccgcaggtgatgatccacacactgtactgcctctaactgatgctcattcaattgatctaaaaacgacacaacatcacctcttatttaccttctcgactattatactatactttgtcttccttttctttagaaaacaacttcaattataacccaaaacggcatggtactctatagttattacgaaattttcagaaatccgccatagtattttaaatttgtttatactataatgtagactgactaactgaggtgtgatacatatggcaaaacaaaaaccgaaacgatactatacccgcacgattgacctgctgtttctgctggtgtttctgattgtgggaatcgtatcctttaccatagcatttacctttggcatccttccggtgaaatggacgatggcagccgcaggtattctgctgattctgttccttatattatttatgctgtccatgaagaagcttcccaagtgggctgtgatcgtcaagcgtctgtttatccttcttttgacggtggttatcggtaccgggggatattttctggataaatcacgaagcacgctgcataagatgagcaaaaatgcggcaggctccaccacggaaatctatgtggtcgtgaaaaagggcagcggtattgattccctttcccagctggaaggcaaaacgatcggctatcagaagggcgtcgataagaaaaatgccgcctatgcaagggaaaagctggacagcgaggttggcaataccacgcccaaggaagagctggattatacaacgctgtacagcgatctgaatctggaaacggtgaatgcctttgttatttccgattcctattatgatatgtccaaatccaatattgacggctttgcggacagtgtggatatcattcagacctacaaaaagaaaaatgatgccgccagcggtcccgatatcgatgtcacaaaggataccttcaccgtctatctgagcggacttgataatatgggaagtccggaccagcagacaagaagtgatacgaatctgattctgattgtcaatccgaaggcgaatcacattgatatggtgtctctgccaagagacggctacataccgaatgccgcctacgattataaaaacgacaagctgacgcataccggaaacgacgggattgaaaacagtgtggaaacgatacagaacttcttcggtatcccgattgattactatgcccgtgtaagcttcaattccctgattgaaattgtcgatacgatcggcggtattgatgtggatgtggaaattgacttctgtgaacaggatgaaaatcgaagctttaagaaagaggacctgatctgtctgaaaaagggcaagcagcacttaaacggcaagcaggcgctcgcctattcccggcaccgtaagaccaagggctatgacaatgccggaagagagcgtgcacagcagcgcattatcaaggcaatcatcaataagctgatctccgcaaacgggttaaccaaggtgaatgatctgatggatattgcaccgaattacattatcaccaatatgccggcagagaagattgcggattttgtatccggtgagctgaatgagctgaagccatggacgatttcctccatcaccagtgataacggtgtctatgaagacctgtatgtggcaagtctggatccgtcccttggtgtaagcaatgtgtatctgttcagccgggatgaggtgcatgcggttgtgaatgcctatgatgcggcacgcagacagctgcagatgaacagctttacgtttaatttgaatgatctgtatgcgaatactccgaagatcaatacctcggaaaacatacgctatgcggatatggcagagaatccgcagtagacttttcaagagctatactgctgaatgataagtaaaaggatatataccctctcatgtagcttggtatatatcctatttttgtgtcctttttttcctgcattacatacccggcaccgtgcagttttttatttctgacgattgctgctttattgaattcaatctgcatagacgaagccaacgcaagcctcctgtatgcttttcatacgcgtgccatgcaaatccacagctcaataaaacggatagatagtttgcgaagagtctgctgtgcagcatccggcagaatacagacagcacataaactcgtggacaaatgtccttgaaaacgctatcacaaattggcataatgtccatggtcgtaaatatgtaaagcgaggtacagacaatgcatgtaagagaagaaatcaacgaagcgtacgagtatatcagaaagcgtacgcactacactcccgcaatcggaatcattttagggaccggatatcatcaggttgctgatatgatcgaacaacctgagcaataccgctatgcggatatcccccatttcccggtgcccggtgtcgcaggacatgaaggaaccctgatcatcgggagaatacaggggaaagaggtggtagtcatgaaaggaagatgccattgctatgaaggctattcacccagcagggtaacacttcccgttcgtgtcatgaagcgtcttggtgtggaaaccatcatcattacaaactgcagcgggcaggccggtgaatccgtaaaggcacaggatttattcgtcattcgcaaccatctgaatttctccggcttcaatcctttgatcggagaaaatttagaggaatacggagagcggtttcccgaccttgcctatccatatgatcgagactgtatacagcagataaaagagcttgcagcacaggaacacattgaactgaaggaaggcgtttatgcaatgttttcggggccgagctatgaaaccgtcatggaaacctatatggcggcaagactgggcgctgatattgtcggaatgtccacgattccggaggttatcatcgccaatcactgcgggatgaaggttttagccttatccggtgttccatgtccagcagccgcctattccgatcaggaaatcacacatgaacaggtaatggagaattgtcagagcatttctgacaaagcgatgattctgattggaagattcatcaaagaattataggaggagcccatatgaatatcattaagaagtcaaccgaactaaccaaaagcccgatttttgccatactatcctgtctgctctgcatccttgcaggctacagcataaagtccagcctcattgaaatcttcgcctcggtgatgggcattatcaatgtatggctgctatcaaaggaaaaaatttcaaacttcatatttggtattatcaccgtgcttgcatatttgtatatctattatacaacaggcttatacgcactggcgattctggcctgctttcaggtcatcttcaatatctatggatggtattactggggaaagggggatgacggcaacagcacaaaaacatccggcttaaacagacaggggcagcttctttggattgcgatcatcctgcttctgtgggctgtatggggttatgtggaaatcaatatcctgcatgctcagaatgccatcctggacagtctgacagctatccttggctttatcgctcaatactggctgagcagaaagctgtatgaaaactggattttatggattataagcaatcttctcttcatggtaatttatgttctgaacggctattttatcatgctgattctggtgattattcaattcatcctctccattgccggattgatagaatggtacgaaagctatctcgagcagggcagaaataaaatcatgttctgattcgcatggaaatacttatataatctgtgatattatacatatgatacacgttggaggtacgtatgaaacctgatctgacaacctttatagccgcctgtcctgccgatatccgctctcattttcaggaacagacctattcctttcatgataagctgatggaacagaataaaaaaagtgactgcatctacatcctattgaacggaattgtaaaaaactatcactttgaaatcaatggaaatgtctacatagaggatattgataccggtgtgacgatttacggagagctggaggcactcattgataaagagaccgtctccaccgtggaagccgttacggaatgcagggtgctgaagctggaaaatgcacagtttctaaaatggctgcgtgcagataatgcatttaccttatatattacgacgttgattgcacagaggaattacgattgcagtaaacgggaaagagtaaatgccttttaccccctgaaatacagaattatgtatatgatttacaacactctgtgcaaaaaagacctcacgatcaccaaggatcttctggtagagggaacgggctccaatatacgcagcatcaacagggttgtgcatacattgatcagggatgggattctggattataagtcgggtattataacggttcattccatggaacgcctggaggaagaaataaagctttacagctaacgcagcacttgttcacgcgttggatgaaatcaaatgtgtttcctatcgcttatgcatcggatatgaatcaaacagctgcagtggatttctatctgtctgatgaaagcttttctgattgatttttcagtaaacatggatttcctgacagaaagctccaccgttgattatcaaaacagcttttccattgtcataaggatttcccgataggatgttttatgataaccggaaaggattgctctcaggtgcagcctaggctgcacgtttcgtaatggcagcttttcttttttgaatatgtaaaaaggcaggacgagagctgagatttgtagtatactgtacctgcaagctatcagatcgttctgccctgttcttttacagatggatgacgttgccgctttctgcggatgcatgcactgcggcagcgattcttgtcgcctgtaaaccatcatacgcatttgtccggaaggagcgctggtttacgatgtcactgacgaagtcctgcatcggctccagtccaaagccgcttgcatgatgttcatcaaacttcatgaagatatagtttggcagacttgcctttttgtcagtataggttttaactccccgataggattcattcttcagatacttgtgctccgtcacgatcacaagctgtccgtcatttgatttcggatacgtattgggaagaatccaggagttttccaccgtccagctgcttccatcctgcatcgtcagaatggcctggatactgtcataggtctgatagccttgcttttttagtacctgtttattcccgactgcatacacgctctccacctcactgccgcttacatagcgaatcagatcatagcagtgcacaccgagaaaccaggagggtgaggattgatcagtccaggtaaaccagttcataggaacatcgatcacatcatccagtgacatatagccgcggatgatgttttctttatccatcaggatttcatcacgcatattgttataggccggatcccagcgtttatggaagtccacggcaatctgcacaccgtacttctctgccatggcaatcagttcttcacattcttctacggaggttgccagcggtttttcaatcatcagatatttgatacctgcctccatggcagcccttgccggttcatagtgataagggtccggtgtcgcaatgctgatggcatccagcttctctgccgtaatcatttccttgacatctgcatagcctctgatctgatagcggttttgtgtggctgctctgcgctcctcgttcaaatcacagaacaccaccgtttccacatgcgggtcacaactatacgtacggatatgataattaccgtaaattccggctcctaccactccgatgttaacttttttcatactacctacctctttcctttacctattgagatacgaaattttatgtcgttcataacgcatcagacaatctcactttgcctgtttcattttttaaattccattatactttatacagggttcaccttattcataatacttcgcttcaaatgccgcatcctctttcgcataatagcgctcgataacctttccgccaaacagtactgcgatatcaatgataatcaggatgcctgcaccgatcaccggtgtctgagccaggacggtcggcagccagataaacatatttccaagagccatggtcgttgcctgctgtccggcctgtacatagctcagtccggcattggaggcgagctccgtgaacagcggtgctgcccagcttgaaatccacagcacgatcggaataaaaatcaggctggatataattgttcttttacggttaccgcggtgaacgatggtcgcaaagcacacatagaaggccgcaaacggtacctcaccaaggggcagcgtggtattgccgggaagaattgccgcaaagaccatgaagaccggaatcatcagaaagccgacactgattgtcacaggatgtccgatggttaccgcagaatccagtccgatatacagttctctgtccttaaaatgtgtggtgaagaatttctttgcctgattggatatcggaatcagaccgttgacgatcatttttaccattgtcggaaacagcatcatgatcgcagctgtcttcatcgtcacatccgcaatccccttgaaatcatagccggctaccacgccgaacagcagtcccatgatcaatcccagatagattggctgtcccagcacagagccgatcacctttccgataccgtgctctccactctcctcttcactttccttacggtgcttcagatagggaatccggtcatataccttatccagcagcatgaacagcggtgcacttgccgccgcaaagccgtgtggaatggagatggcatcaataccgataatttcctgtgtgcgatgtgccatgacatctgcgaccttcagtcccagaatggcatgtgtgactcctgccaggattgccagccagtagcttccggtaaggagctgaacaaagcctgctgttatagcaaaataccagaagttgtaaatgtcgacattcactgttttggtcagctttaaagcgaccagaacgatattggtaatcagaatgacgataatcagcgcagccccaagcagacttccgaagccaacagctgccgccggtgatccgccgacatcgattgcggtcagattcagattcagcaccttgaccatttcattgatgaccggtgacagggaatctgccgttagggttgatacaatactgactccgatgagtccgattcccaccgttacccccgctttgatggccttggaaggcttcagtccgaaaatcaatccgatgatgcacatcagaatcggtacaaatacataacttcccaggtcgacgatatactgaatgatgtctaatactgtctgcataattttctctcctgttcttatccgcaagctacgcgagaatatccataatctgttgcgtaactgcttcctcattgatgcctgtcaggtaggcactgccgtgaacgagcggtgttgtgaatttcttctttaccttcatcgtcgtgatgatcagatccacctgaccgtcatagccctctacctcgtgcagggtgcattgcatgatttcacaggaaatcccatgctccttcagttcctcctccaccttttcacgaaccatgctggaggttgccagtcctgccccgcaggcgattacaatttttttcatactcgtagcctctccttttccttatgatttctgtccttctataaatgcattcagctgcctgcatacctcatctgcatcatgcagcttcacaagccgggtaaacagcgtgtcatcccccagcatccgcatgatggtctgcagcattcccagctgctcatgggcactgctgattgccatgagaaacaccatgtcaacgtcaatttcactgtccatatcctccatgttgcaaaagcggatcggctgctgcaggatagccagtgcgacatgattgccgctgactgccggatcaaaggcatgtggtatagcgattgccgcacatttggtacgcagcccggttggatattcctgctcccgcagcagcaccttatccgcatatgccgcatcactgcatccatgtgttttcagcttgtccgccagatagcggatgacctcttccttgtcctttacacatacatccgtttcaatcagttgcggtatgaattgaaatcccatcttctctccctcccttcgattcctttgcctgaaaacattgaaacagctcctgcggcgtgttgcttttcagcaggcttcgcagtgttgtctcatccgttactacactcgccagcatcttcaggattcgcagatgtgattttgaatctacagaagccagaatcatcaacaagcggatcggtatgcttccatcgtcaaaatataccggtttttttaatgacaaaatggaaatctgatttttccgcacgccctcctcaggtcttgcgtgtggaagtatgatgtagggtccggccatgaagtaaggtccccatgcctcaatattgcgaagtatggcggctgtatacttctcttccacaaagccgttttgaatcaatggcttcactgcggtttctatagcggatttccagtcacaggagcgctcctgtatctgaatgttgtcaacggacagcacttcttctttcattgccttcacctccatgcctgaaagatatgcatctctttacaggttcattatacaaatgacagcgtatagaaaaaagtccaacctgaccgaacttgaaagtgcaagtcgttggactctattggaattaggaaaatgcatgcagcagtgccctgcgtacctcggctgcgcttgtgcatacatccagctgtgcaagcagcgtgctgtttctgctcagctgcaggatttcgtgcaggacattcaaatgcttgtcatgagcagcatccgatagtacaaacagataccgcactgcggacacctcatcaagatatacatcctcatgacagatcagaagagacagtcccagacggaatgccccgtgctccggcttcgcatgggctacggcaacggaattcgccagcaggatatacggtccgtactcatccaccagatggatcatttcctgtacatagctgttttgaatgacaccgcggctcagcagcggtgcggatgccgtctgaatcatctccttccaggaatccacctgctccagaacctgtatatcctccttttgcaatatatccagcagaccgagctgctctttatcatgaataccgacaaaggagtttccccggttgagataggccagaacatcccgcttcagggcgtccatatccgtttccttcacataggaggcgatgatggaaaacagaccgcccagcttttcattgttgatttcatagcagttgaaattcagcatcatcatggaagcgattcgtgccttatcctctctgcttaaaatcggatgcacccggattaccggcacctcgctttgtacatcgattgtcgatacaatgaaatccacctgctgctcatattcctgcacgtgctccagactcgcggtatccacaacccgcacattcgcatacagcccctcgatttcccgcttgagaagcatggatgtggaaataccgctgggacagacaatcagaatacggatttcatcatagcagcgcactccctgcttcagatgtccgccgaagtgcatggtcagataagcgatttcactatctatgatcggcatctgaaacaaatccctgaggtcttcgcataccagctgtgtaatcatataaatatccttgtactgcttctgtatttcatcgatcagcgggtttacgacctggatggaaagacggttgtaatacatggacagctttaaatgcatatagatggaattgatcaggtcatttttatcatcaaaggatacacatgccgtacgctcaaaggtttccacaagacggctggataattcaaagatgcggatatcatgctcatcatcctgcggacacagctccctgcttgccttggagcccaaaagatgcagtgcgagatacagccgctcatgcacattcagctcctgaaaataacggtcaatcaaatccagctcctgtgtttcacacagatcacgcagctccatgagagaaaaatcatactgctccggtgaatcgcggataatgctcagcatacaggcgatggatagcagattgtcctgtcggtattcatgctcacgctcactggatattttctgtagtcttccataataatcgtccaccagcgctgtgtccagaaagggcaatgcgtgataattcacctcatccagcagctgcttcagaaaatacagcagaaccgcccgcttgttgaatgcctttccctcgatgccgtatccgtttttcaaatcgatgcgcagctccagaccataggctttcagctgctccttcacattcttcaaatcactgaacacggtattgcggctgcattttaacaactgcatgatatcctccacatgaataactgctttgggatagatcatatagcagatcagaaagctgacacgctgctgaggtgtcagtacatccggctgcagctgccgctttttcagaagggcggatagctgctgcttctgctcatccaatagaaaataaccgactccccgtttgcacatcacaggctccagtgcattcatctgcagcacctcattcgttttattcacgatataatacacacttcgccttcctgcatgcaaaagctgtgatatttcatccaacgcaatcggtgtgctttgttccataagcagctgaatcagctgcagctgttttcctgtaaacggtatcataacgaatccctctttcaattcaagtatccttattctataatatttgcggcaaaaaatgcaaatcattccatatttatcctgatttatagtttattttcataaaattcataaaacgttcacatagagtaattacaggtaatctggaatttccgtactttttatactataatgtagattattgaggtgttttcatggaaaataaaaaactaaaacgcaggagcctgattatcgatatcatcatgctcgctgtatttctgatggtaagtattgtatccttctatatcgcctacagcttcggactgctcccaatcaagtgggttaccatagcagcagcaatcttcggactgctgtttctgattttactgctactcgcatttaaacagatgccgacctggggcttagtcatcaagcggctgtttttgattctgcttgtcgcaattgttggcaccttcggctatttcatggagaaatcccgtacgaccatcaacaaaatgagtaaaacgaccaaggtcaatgatgacggtacgacaaccattaccacaaacctgtacctgattacatcaaaaaccagcggtatcaggaatgaggcagagcttgcggataagattatcggatttcagaacggaagtgatgcagataacctttcctttgccaagacctcggtatccaaggacatcagctcctatactgccaaagaggaaatggattatacgacactctatgatcagatggagcagggaaatgtatccgcaatggcaatctctgaaaccttctacaatatgtcgaaagcaaacatcaaggattttgagaaaaatgtacagattctgaaaacctattccaaaaccgataccattaagaccaaggaacagaaggacattaccaagcagacctttaccgtttacctgagcggtctggacagtaccggttctccggatcagcagacgcgtaccgataccaatctgctgctgattgtcaatccggtcgcaaatcatatcgatatggtttccataccaagggatgcgctggtacccaatacggccctgaacaatgccaatgacaagctgacgcataccggcatctatggaatcgatacgagtgtggacaccatctcacagttcttcggcattccggttgactactatgcacgtgtcagctttaattccatgattgaaatcgtcgatacgatcggcggtattgacgtggatgtggaacttgatttctgtgagcaggatgaaaaccgcagctttaaaaaggacgatctgatctgcctgaaaaagggagagcagcatctggatggaaagcaggcgctcgcttattcccgtcaccgtaaaaccgagggctatgacaacgccggaagagaacgtgcacagcagcgtatcatcaaggcaatcatcaacaaactgatttccccgtccgcacttggctatgtcaatgatctgctggatgtcgctcccaattacgtgattaccgatatgccggcaaaccagattacaaaatttgtttccagtgagctggataatatgaagccctggacaatttccagtgtcatttccgataccggtgtctatgattcacagcaggtcgcaagcctgaatccgctggagggaccatatgatgtatatctcttcaacaaggatgaggtacacgctgtcgtcaatgcctatgacggcgcaagcaaccagctgcagatggagagctttcatttcaacatggatgatctctacagggatactccgccaatcaacgatgatcctaatatcatctgggacaccatggcaagcacgccgcactaacagccatacgaaaacaccctatgacagggtgttttttatgatttcttatactgaacgagttgtagctgtgaaggatgggaaggataaaagacaggacaatggaatgaggatgtgccttttggcatagcctgctggcagtacaaaaaaacgctctttaaaggatactctgcctcctttaaaaagcgtgatcagcctattcagctgtgcagctcatcgctgatggtaacacgatgcttgattccctgacaccattccttcagcatcgcgatatcctgttcatcacgcacaatgcactcaagaaacaaggtgtccttttcacagtttgcctgtacaaccacggtatagtattcatccagattctccacaattcccttgcagatcaccgcttccttttcgaagctgaaggcgtccatgacatcgaccggcttctccagcttttccaggaatgtcggaatttccttttcgaaggtataggcgtttgccttgatcatccatttccagggctcctttgcatccttgtacggtgccataaaatgcatcgtctgtgttgtctcatcaaagcttttttcactgcagccatgagcaggaatactccagcttccgaaaggataggaaactactccgtttcgatagcccagatgcgcgatcttcagctcatccgcatgctgaatcagaatctcacggtggattgccgtacagatactgcgataggcatccatcggcagcggaagcaggtcatccttctcatacgccgcctccagataatccagaatgctgttggcaatcttatccgtatattcattcatagagctgtatgcaaagtaacattccttccacagcagcaccatggcgcagttgcgataatagcgtgcagtacgctttcgatcattccatacaaagaaatcatctgccaagtcctcgacatcccttgtctgaaaatcatctctgtgaatataacccagcggtgtgacgacaaagccctctctgtagacagggtgataatactcctgcggccaggagatgcataattccttttcctcatcgatatgatccagaacatagccctgtatatccttcagccagcggtaaaagtacttgtatttcaaattttcaaaattgcggtccgtataatatcccgtcggatcgtttacctccagcggaatctgggaaccgctgataatctcatcaaaaacagtgcagacaaaagcatggaatccgggtcctgcgacattggtctgtgccgcaatactcacaaagcggtcctcatagccgcattcaatatacccctccggacaaatatcaatcatgacggtggcatcataatcctccagcttcagctttttctcatcgcatacctgctttagaaaagcactgaatgcctctttgtccgtttccttttccagctgtccttccaatacaatttcaatagacattgtcaaaacccctttcaaaaaggaactgatttctcagtcccttattcaactgccaatacacgatagacatttttcatttccccatcgtagatgacatctttcttgtaattctttgtacggtcatattcataatcctgaatttcgataacgctgatcgtcatggacttcttcagactctccacttccgtttctgcataggtcaatgtcagcttgacatcgtatcccctgcaggcagagccgttataggtaaaatccttggcttctacagcatccaccttataaccggatacctccggcaggcttttcttcccgtattcgtttacgatggtcggataatttccatagtagtatgcctgtgcaaactccatgaagttgcggatcttatcgcttggtatgaactgcagtccgccaagatcctgggcatcctctttgttggataatgtaaagaaatcaaatgcaaagctgactgctaccatggtagcttcctcttttctgtcctcgctggtaattgcttgcgacagcttgttatacgcctcgatttgcgcctgcgttggattcaagggctccacatataaatcattggcaaccattttcacttccgccttctcttcatttttcgctgtttcttttttcttgctgctgtcgtcagagctgcatccgctaaccatagttaccgataggattccgacgcagagaagtaatttctttgctatttgattcatacagacctccacaaaacgtttattagtatatcataatttttcaggaaaacctatgcgttttgacaaatttaataatttcttcagaatacatgccgcctccctgagaaagccgggcacttccgcctcccttcaggtgataggcatccgcaatttctttgaatacctttgcggaatcaaagtccatatccttgtgagaggctacgactacatgaacattgtcatatgtctttgccacgaagatgaccgcctttttgtaattctccgttacatattttgcgacatccgcttctgatttcacatcaatatcatcaaagaaatggatgatgatatcctcctcgctctgtccaagctcttttccaaacatctcataatacttctgcttccagacaacgatatcccgattcagctgacgtgtttcattgattaaacggttgacaccggtatttacatagaggtgggatacagccagggaacggcttgcttcatccagcaccttatagcgtctggaaacgcagtcaagcagctgatcgccgaccagatatttaattttatacccctttgctgttttttcatacccgctgatgtacagcatctgcaggtagcgaagggatggaacatgcatacagccgcacatattgtaatccagtgccccaatgcgtacaacacgcagatcatcgcggtcaaggtttttacccttggccattttgcttgcctctacccttgtcggatactgtatactgacttcaagatcatcgcgaatcagaccattgcacagaacctgcagctcaaatgccatcttatcggtgaaatcctcaaagctgaattcaatatcattttcctcatcccctacatgatgagccagtgtctccaccttataaacattgccgagaaccgcactgatcagatgctgtgccgtatgaatctgacatttacggaaacgttcatgcaggttcacactcataaagaccgtaccctcaagtcgggtatccagaaggtgccacatatgaccttcctcatatttcaaatccagtaccatgtgctcgtcgatcataccgatatcactggccattccgccgccttctttataaaagatggtatccttgcaggcatgccagaagaggccgttatcttcccggacttccagaaccttggtggaaagctccgttgtaaagcaattatcatacagtttgttgatcataagtatcctccttttccagtgtattttcttatattctaccacacttttgtgtctttttctcaagaaactcatgtaactaacacgttatctcatgatataatggtatgcgtcaggagttgatgaaatgaatcaggtagcgaaacattggaaggactatgaatgcatcgatgccggcagcggggaaaagctggagcgatggaaggatatcatactgcgccgccccgatccgcaggtgatctggccgatggaggaaaacagcatgtggaattcaccgcatgcacattaccaccgttcaaaaagcggtggcggtagctgggaatataaaaagaaattcaaggatagctggacggtctcatatggcgatctgcgctttaaggtttctccaaccggattcaagcataccggcctgttccccgagcaggctgcgaactgggactggatgatggatacgattcaaggcagcggacgtgaggatttgcgtgtgctgaatctgttcgcctataccggcggggcaaccatggcatgtgccagtgcgggagcggcagaggtcgtacacgttgatgccagcaagggtatggtgaactgggccaaggagaatatgatgctctcccatctggagaatcataaaatacggtttatcgtggatgatgtgctgaagtttgttgcccgtgaaaaaagaagaggcagaacctaccatgctattatcatggatccgccaagctatggcagaggaccgaatggagaaatatggaaaattgaggaacagctgtatccgctgatctccgcatgtatggaaatactggatgagaacccgctgtttttccttgtgaattcctataccaccggatttccgccaactgttttatacaacctgctgcgtaccaccgttggtaaaaagcacagggatggtcagattgatgccggagaaatcggtctgcccattacagccacagacagtgtgctgccatgcggaatctatggaaaatgggttagcagtaagcgatgaaagcattgtcaaaataccatatgaattacgtttgcatgtttatgaataaaggaatccgaattgctatgtgtatacaatagctctggattcccttttttttattatttcagtatcttcctgcgtcttttatcatttgatagtgtaagcaaatcatgagcaaaaaatgaaaaaaagcagattgcatggaattacaatccgcctgtctacttcagataagacttccagatattcagctcacgctgagcactttcatgggaatcggatgcatggatcacgttgttcaccaggcgtacagctgcagatgccttttcatagctgtcatcgctgtatttcccgcggatcgtatctgcaccggcatcctgcggattggttttccctgcaagtgtccgtgtaagcgtgataatatcgtcacttccctcatagctgacctccatcggcatgatggtatgcggtccgtcataataaaaggaattaaaaagttttcccgggaaattaaaatccttactcatggaatcgatcacacctgcgtaatgatcaatcagcgtcttcataacacccattgtaaccgtaagtgtacagcttttctcaatcacgagtccatgagagcgcagctccctaagaacctcctgtgcatgtccgcctgcaaacgcatccggcttcagcatcaaaaatgttttctgtttcatagtgacctcctgtttttctttagtatacaccattatttcagaaatttgtatcccctgtcctgcttccgtacaaaagggttactgcttgtggatatacgtaatcatatcagcgatgatttccacgcggttaaagggtgtgatcagataatagccatcgatatagggccgcatttcatccatggttttacagctgatatctactgccagtttctgtgcctcctttcgcgttgttccttcatacattgcgacgatttcttcatccacttcgattccggaaatttcattgttcatatacaccgcattgcgatgggatacaatcggcagaacaccgcccagaatataggcctgcagctcttttcttgctcttttcagattgaaaagggcctgccgtgaatgtaccggctgtgttagaaagccttccattccctgcgtgaccttgcgctttgctttagcaagctcagcttcgaaattgacagcgttcagattcagtgctccaaaaaccataaagggactggtgaacatcgtttcattcagatcacggatatagcctgccagaatctgcgaattgaaattgaagactcccttgacctcctgacggtcctcactgggaatcggatcgcctgtaacaaccagtacattgcgaatcccttcaatctgcagaccgaacagcagtgcctttgtcgcattgatattgcggtcacggcaggtcatatgcggtatgacatccagacccagctcccgatgcagcttgcaggcaatcagtgagctgtcaacacgggcacgggcaatcggacagtccgcgatggttacagcatccactccggcttcctttagaaactccacatgattcataaagcgttcaatttcacaattcgccggcggatcgaattccactgctatgaccggctgctttctctgcagctttctgcgcaggggattgtgatcctcctgtggaatacgctctgtttcctgtgccggctgctgtaccttttgtatgattttatgctcctgcagagcttccctggtcttttgaatgtataccggtgttgttccacagcagcctcccagcagccttgcacccttttgccagatttcccgcatttcctttgcgaaatatgtcgagctgtctctgaaataggttctgtttgccagaatggtcggatatccggcatttggcatgatcagaatcggcttttgtgttcgatcgatggaatccagcagtcgcttcatatgcatcggaccgcacacgcagttcagaccgcaggcatccacatgctcatccgcaagacaatcctgcagcagacgactcattgcgattccctgacggctgtatccatcagctgtaaccgcaaaggatacaataatacaggcctgaggacactgttctttgatatacgaggttaccgcatgcagctcctgcgtattcagcagcgtttcaaacaggaagcaatccgccccctccgcaagaaacacatccgcgattcgctgatactgctgtgccagagatacatttttctgttccatgatcggcccgatatccgcaaataccttcaccttgtctttggctgctttcttagctatgcgatagccctcctgaagaatgcgccgtatcatctcccagctgcattccagatgctgttcattcgcggaaaaggtgttcgtcttaatggcatccgcgcctgcctcaatatactcctgatgaatggccgcaacccgctttggatggtttagatttgccatttcacacggcttttgatcctctgcatagcgctgtgcataatatgtgccaaaggccccgtcaaacagcatatatccctgtgtattcaaatagttctctatcatcccagcacctccttagcgatgtccgcgctttcctttgcatccctggcataatagtccgcatgaatctgctttgcatagtcggcagatacaacagctccacccaccatgattttacactcatgcccactctcatgcagtgcctgtatcgtttcctccatggatttcagtgttgtagtcatcagcgcactcagcccaatcagacgtacctgttccttaatagcggtttccaccacagtctccaccggtacatcctttcccaaatcaaatacctgatagccgtaattctccagaacaaccttgacgatattctttccgatatcatggacatcccccttgaccgttgccaggatgattttccctttggatatggattccagtccgcctgcctgcacggagcggcgtatctcttcaaacgcacactgcgatgctgttgcggcattgatcagctgcggcagatagatttcttttttctcatagcgggcaccgaccgcatccagtgccggtatcagatgctcattaactatctgcaacggttctttttctgacaaaagcttcgtacagagctgccgtgtttcttccttcagcccgcgcatgatgctttcttcaatatttatatggacagattcaatatgcggctttccgccctcccgcttctgctgtgcatatatgcggatatactcctgcgaatcaacatcgattccctgcaggacacggtagctgcgcacggcatccatcatcgccgcctgattcggattcatgatcggcatactcagtccggcctgcatcgccatcgtaagaaagctctggttcaacagaatacgggatggaaggccaaaggaaatattggatacacccagcaccgtatgtacaccgagctgttcgcgaatcgctgttaaagcctgcagggtttctttagcaccgctttgctgggcggaaaccgtcagtgtcaggcagtccagaaaaaccctctcctttgcgataccgtagcgctgtgcagtttctacaatgcgtgtcccgatttccaaacgcttctgtgcacatgcagggataccgtcctcatccatggtcagtccaaccacattggcaccgtatttcttcaccgcaggcagaatactttccataaccgccgcttccccattcacggaatttacgatagcaacaccgttcactgcgcgaagggccgcgcggatcacagccggatcggtggaatcaatctgcaagggaagatcgatcacggattgcagctccttaatcacctccaccatcatttctttctcgtcgatacccggcagtcctacattgacatccagaatatcggctcctccttccacctcttccatggcgatcgcgaggatttcatccatacgatgctcctgcagggcagccttcatgcgcttatttcctgtcggattgatgcgctctccaattacatgcacatcctgtatacgcagacatttggtcggtgtacaggcataagagccaatgcgccgcttacgtttttctacagcgattgtttttggaagtgtattcttcagctcctgtataaactgaggggtcgtaccgcagcagccgcctacataggcaaggggaagctttgtatatggcagcagcatgcgtgcataggcggcagcatcaatgctgtaggtattcgttaacggatcgggtagtccggcatttgccttgatgatcagcggcagatttgtcatcgctgcaagctcctcagcaatcggaagtatctgatccggtccaagagagcagttgattccaatggcatccgctcccagcccctctgcacataaggcaaagctggccgttgtacagccggtaaaggttcgatgatctgcctcaaagctcatggtcacaaaaaccggaagctgtgtatgctccttagctgcaagaatagccgccttcacctcatacagatcactcatggtttcaaatataaccagatctgcacctgcctgttcccctgcaactacctgctggcggtacagctcataggcttcctcaaacggaagatagccatttggctcaagcagctctccgattggtccgatatccagtgcaacctgaacgccgtttcttcgtttcgcggctgattttgccagctgtaccgctcttgttatgacttcctccaccgtatactgtgacttgcacagctttttggcatttgctccgaacgtatttgtatagataatatcgctgccactgtcaatataagccgcatgcacatcttcaatgatttccccatgctccatcatgaacagctccggagaagctccggcaggcagccctttgtcctgcagctgtgtacccatggcaccatccagaaactggattttattttcaatttccacagaatttccctctctttcgataggcacactgcttcaccagttggcagtgcccgcacccgcgcaatacagcgggctgtatccgatccgcaatgccgataatagcggtaacgcttttcatcggtaccagcagactgctttcattcacatgaagtccaatacgccgttgtgcatccagcgcctgaagaaaggatgcctgcagggtgatcggcaaatcaccataaccgcatgaatagcggtctgtcagataaggatagcttttctgcagctccttttgcagattatcgcagacagcctcgatggctgcactggcacagctgtcaaacaaaacagccttcatcatatcctgtacctgcagctttttcatttccttatcgatccgtgagccaagcgttgccgccatgaatatacaggcatgactttccttcagcaaacgctgtatgtcacttcctataaactgcacaccgctatccacaggctgcgcatcatgcagtccgaatacacgatatacgacacgcggttcactgtatcgcagaaccagctgtttcatttccttcaacactgatcgtgtctgttcatcaggattgttttccccataccctagaaaatgcaggatttcttcttcgctgatatctgttaattccctacgcataaaccgcaccctccttataaataaaaaagctctcccccataggacgaaagctgtatttcgtgtaaccacctatttcatatccgccactgtcagcgaattctcttcagtacgccggaagcatccggttataccgcagtgctgtaacgggcactttcccgtcatgaactctgattgcccatgcaactccaagaccatcttcctcagggcttccctgttttcttccaccatatccgaaaactctctgtaagcttcaccctgcatactcttctcttccttgtctttgatttgttacattttatcatgataatgttttcacatcaatgaaaacaaatgaaaaaagcagagcaatctgcctatttctccataaactcccgaatcatatccaggcggttttttgtgtcctcatatcccagatcaaaccagcgtcccagcagctctttatcatgcgtatagcgtgtaaccccataatctgcacttggacgaagaacaattgcatttccctgttcctccagctcctttacaatctgccactgcttctgataattgatatggcggattttcagattctcacggattgttttattccccggatacattagcttcgccagctgaatctgccatccaggtgccggtttacgcacataattttcttccttggtggaaatgaatacatgcttcgtatttccctgccgaatgctctgctcaatcggaatcatatcaacaagcccggcatccatatacgtatgtccgcggaatttatacggccgtgtaagcaaaaacagggcacagctcgcctgcatcagaatctgctcttccggatcaaagtattcctttggaaaatattccacctcattggtatccatattatatacaccgatatccagtaatgttttgttgttcataaaggcttcatagtcaaggggagcatgcttctcgatgaatttgcatacgtaaccgatgccgaacacacccttttcatgaatcagaggagatacaccgattgcacctgattcacatgccgcatccactcctgtgacacgtagacgatccttctgttttgcgacaaacggcagcagaacctctgcaccggcactgattccaacggtatatggaaattcaatatcatagtccagaaaacactgcagaactccacaagtatatgcagcctttgtgcctccgccttcgcaaatcaaaccaattttttctgccatttttctacacctcgcagccctttcattatactatgagctgacggtaaggtaaagaaataatttacctgtaactgtaaataagacattcaaaagaaatcgtttatccgtcattctgttttcagatgaagcagtgtgtaaaagccgatcagagctttatcccacagtgatatgccgtgctgataaagtcttgctagcaataaaacattacatacttctgttcctgaacagctcgaatcaacaaaagctcagccgttcgcaagctctctgttatgtagcctttttcataagcaggatctgtatacagctgcagtggaaacagttttatccatgcataaatatttttttcaacctgaagctcatgcagaagctcccttatttcctgccatgagcgtatgatcaggtagcgtctgtccagcatatggtcagatatcttttcagcgataggaaactcctgtatatcgatcaggtgtttatgaaaggattcttcatgtaatacctgatggctgatatgttcatcctccagctccatcaaccggtttgctataacatcatcgataataaaaagtgcacttgtatttttcatgtttcctcacttccttttttccattatatatattcgaaaattagtttttggttagatacactgatataaaaagaaaacagccacattcatgactgttttctaatctttatgagcgagcggtttctgtattgtttttgttatcatccagttctttccactttctgccaaacagaacgaagattacctgtacgattaggaaggctgccataagcagtgtccatctgtcaaccagaaccatcgcaagtgtaatatcctccgtaaggaagaatgctattacagagacaactgctgttatcgtgcttgccacacgcagccattttcttctcttatagccgtttgactgttcttcatcatttctcattgcggaagtttttttcatcttcctcctcttcctccttcttcagcttggataacagaaggaacagaccgagaagtaccgtaccaccggcacagatcagattgatcaatgcccattcattctgtgagccgccgcctttcggagttggattttcctgaacctctgtgctttctccaccctgcggctgatcaggatcatcttcattcacaatcggtcctggattcggtgccggtgtcggagctggtgtcggtatgaccggtacgacgattggaggagtaattggattcacaggaatctgaggagctgctggtgctgccggtatcggagtacctggattttgtggtgttactgcaggaggcgtaggtgttaccggcgttggaagtatcggagctacaacctctgcaaagcctgcagtaaatacggtatcctcagtgaaataggtgtttctcatagcgtctgtattcacataagcattgccatttgctgtccagctcataaagctgtacccatcatttgcaatagcatctaccaatgcctgcggtcttactgctgctgttgtatcgttacccggacgggtaacatattctacggttgttcctgtaacggagccattggtatccgcaacatatgcaaagcgtacctgatatttatccggtgtaccatccggtgttgtatccggattcggcaatccgcctctggtatccgcagaatagtatacgttgacggttacatgctcactttcaacgacctttgtatctgcaactgtaaacacatatcccggaatgctgattctgtgggcttcaccatacagataggttccatgctcgatatcatttaccgttatagcaggcgcgagttcttcccctgtatcctcattgaggaaacgaacagctgcagtataggtattgattgcataattggccgtgaatacagccccttcgcttgtaatttccatcccctgcttcggagtctgcggagtccagtttacaaagtgatatccactgttcgctgtagcagttgcaatctgattttgtgtaagtctaccggttccgtcctcagcataatttccctgcttatcatagagagtgacatatgtcttgttgaagctgacggttccgtttactgctgcgaatgaaacctctgcctgatatttatccggtacattgtcaggctgctcaggatccgttgaatctgaaccatgatgatcttcttcaaagcttgcgtagaatacagtattactatggataatatacgtacttgggtcattgatttctataccttcagggtgatttacatcccttactatccatttatcaaacgcatagttcaaattagccgtaggcactggcattgcaaatcctgtgatattgccaatccttgtatttgcaagtataccactatataaggtagtacctgtaagtgtaccatttgtctctgctacaaagttcacattatatgtttcttccttataatccggctttccgttcccgttggtatcctttgcgaattcagcgtataccacagtatttcctgttaccttataggtcccaggctctgccgtttcgataccggctttgtgttctacatccttcactacccatttatcaaacgcgtagccttcatcagcaactgcctttggctctttgtagccttctgcactgttgattgctgtgcctgaaagataatctttatataacgtggttccttccagttttccgttttctccggctacgaagttcacattgtatgtttcttccttgtaatccggcttccgtttccgttggtatcctttgcataataaacacgaatgatattatttgctgcttctgtatcaatggttaaaggattgttttttaccttatccaaagcatacggacttcccccatacgttacagagacatccgggttcagtgtaatcacttcttcgaatgcagcattctttgtatcggttttcccctttacaccgtcataataatattctatgctgtagtcgtagctgccctttgtaaattcagcaatgaaactggtatcctcatttaaatccagtttcgttgtcggtgttttcggagaccatttcaagctattctgatcatagcctcttgccgctgtagctgtagctatctgttcgtcactcagatgtccgattccaccgtcttcaacggttgcatattcgctattcttatacaggataacgtagaacattttatttcccggttcattctcatgtaccgcatctattgttccgtttactgctttatacatcacctttatctgatacttatccggaatctgatccttgttttcatccttgctgtaataaacctttatgatattcttcttattatccgtatcaatggttaaaggattgttttttacctcatccagagtatacggacttcccccatacgttacagagacatccgggttcagtgtaatcacttcttcaaatacagctttctttgtatcggttttcccctttactccgtcataataatattctatgctgtagtcatagctgccctttgtaaattcagcaatgaaactggtatcctcatttaaatccagtttcgttgtcggtgttttcggagaccatttcaagctattctgatcatagcctcttgccgctgtagctgtagctatctgttcgtcactcagatgtccgattccaccgtcttccacggttgcatattcgccattcttatacagggttacgtagaacattttatttcccggttcattctcatgtgccgcatctattgttccgtttactgctttatacatcacctttatctgatacttatccggaatctgatccttgttttcatccttactataataaacctttatgatattcttcttattatccgtatcgacactcagcgtattggcttttgtaaatgtaaagttttcaattggaagctgacagctggatccttctattatatctccaaattttgcatccttatattcatcatcatgaatttttttattgctatcctcatcaaaatgctggattgtatatttctgatctgttttcttccattgtgcataaagagctaccgaagttttcactgtaaatttcgcatgtgctgcatacctggttcctgatccatcggcctttgtattccatccggtaaatatatagccttttctctgtggaaatccttccaaactgctataatcttttacctcgtattcatttcccgtcaccgcatgctcaatcacggatgtatcaaaaccgtctatattggcaaaataaccaatctcaacctctactgccttaatatagccatccacatgcggcttttgattatcctgtctttttattgaataccagacaatgttagtaagctctatttccttccctttatctacaccgtttctgacagtgtatttcaaaggtatgtgtccttcgggaacgtaaatgtagttactgtcaacaccattttcgttcgttataggcttcttgtttacataagctttctggtatgcctcatcacttataaatcctgagaagccggtcccctgattatgcattatatcatttcctgcccagtttgggccataccatggattgctgtttgaagggacgaaattcttcggattgtaattacctgccagatttttcggaagctcagagctaggtaatagtacaaagaattcagcctttttcgtgtaagtcttattctcataaacagctttgaaattcattttactatgaatagccatagctgatatatctttaccggaatatattttctgatcctggtccagtttccagcctttgaaatttttatctttcagtacaggtgttggaatcgcagtttcggatatacgattgcctctttcagcatgaacaattacaggttcttccgaattattataagcacccccggctaaatcaaatgatatatcgacaggtgcgcttaattcagctttggaatatacaagagtaatctcattgcttgtattttccaataccataacgctagcattctctttttaatgctgtatacccgttaattgcctttgcatcaattgtcagcaattcatgcagcttcccctcttttacatcatccgctgcgagccggttcccctccaggtcctgataatgaatcgtagcagtcgctttcgtatagacattgattaccagatttttttctgattccccaacctctctgttataaactatgctgttatcaaatgcctcgccatttactttgacctgttcaactgcatagttcgcattagctgttatttcagttttctccggattggtagctgaaccaaatgtcagtacccctgacgtcttttcagcgccatccacatgcactgcgacatttaactttgaaactccctcaggaatatcaccgcttcctgtctcatatacagcgattggcttattctctgttgtaatctgtacaaaatcatctgcgtaagctatattgtcatttgctacaatagtagtcatagaggatggtaccagctgcaatgtcattacgatagctaacagcaacttactgaacccttttttcatatacatcctctcctttctcttatggtgtatataaagtatttcccactttacacgattagtatagagctggaggagttagaatttggttagattgcatcctcggacaaaaaaaagttcagcaggtgcatgaactcttcatttctaatttactgatttgtattctgtatataatagtgcagtcgttccttacgattacgcacctttccctgaaagctcgaggatacacgctgtgcaatccgatacgcatcatcctcaagccggcatggcagaaggacaagaaactgatatcggttcaatcgggtgaacacatccccgcttcttaaagagctttgtatggagactttcgccttttccagtaatttctccagacgtttctcatcatctccgtctgctttaatttcgaaaatgaatagaaaataccgtaaattctcgcgtactgcatttcgcatggaaatttcgtaaatataatcaaatgcagtattatcacagtataatgcccctctggaaatttccttgctcttataataggaggtgataccctcaatatttttcttctcttcattatttccgatgatatcggaatacagctctttcattttttctgaaagactgatcgcatattcgcttaccagcatcctggtagaggtctggtaatattcatatgccgcagcgtaatcgccctcactgatgagagcctgtatataatagaaatggttttcttcaactgagggctccagagtggccgccttcaacgcaatgctttttaattccgcatattgcgcactgcgaagataatacgcacacagcttatccgttacggataaaaaaacattacggaaatattccaccttctgcatgaaccacagctgctccgtatcgttatataaaccgccatcatacaaatcaatgattattctcgcatgtacggaagtattgtcgtcatagctggctgccttttcaattgccgcaaattccttctcaaacagggatgtatcgacgatggtttcaatctccggctgaaaacggtaaccacccttttctgtgtgtataaattcgatatcctggaacgtatgaatttccttcagcagcttacgcagacggaagatgttgaatttcagagaactcagcggattatcactgttttcccaaaacagctccatcagaaaatctctggagacgttattttgatcctgcaggatcaaaacttccaacaggctgagagactggcgggacagataatcccgcatattgaacacttctccaccatattcaatcgtaaagccgtcaaacaggtggataaattttactgctgttcatgaaattcctcctcatctcatttgtataattgctgctaagtaaatccatattccaacacatagattccctctgaaaaaaaacctgccttatcatgctactgcaaaatcggaagaatgtccacaataaggcaatgatatttgtaaaaaaagaaatttaaaagctgcttcccggggttggatgaagtcttattcttatgcatacagatacatatgcttaattttcattcaaaaaagcgctcaccgttttctttatgaatttactgataccgatatgtgacaaagcttctttgataatgatttcaaatggataaagtggtcaaaggcagagccgtacatgcacatcctgtatatttatcgcttagttaggaactcatttccttctacagaaagaaaaagacccttaggtcttttctctttacatcatcggtgagaacagatttaaaattgcccgcatgatacgaatcggaagccggatctgccggcattcctccagtgttacctgatgactttttgaaagtgtttcaagataatcccttttcacatccataaccaccttgctgcgatagaaccatacaccgcattcataatgcaggtaataggaacgatagtccatgttcaccgtaccgacgattgccattttatcatctacaacaaagctttttccatgaacaaagcccggtgtgtattcatatatttttacaccaccctcaatcagatccttataattggagcgtgttactgcgaatacataccatttatccggaatatgcggtacaagaatacgaacatcaattccatttttcgccgccagcagcagtgctgttttcatctcattatcgataacaagatacggagtagtcgcatatacataccggttggcactgttaatcatattgatatgtgtatattctccgacattttcctcatctgtcggggaatcgctgtacggctgcacatagccgtcattgtgaatattctcaaacaccttgaaatcgggcttataggaaaatacatcatccttttccttttcatcataattccagaactgcagaaacatcagcgtcagattccatacagcttctccccgaatcatgacactgcagtccttccagtgaccaaagcgctctttctgattgatatactcatctgcaagattgattcccccggtcattcccacctttccgtcaatgacaaggatttttcgatgatcccggttattcatctgcatggcaagccgcggcttgatcggattgaacacctttgcctgaataccaagccttctcagtgtcagatagtagtcctgcggaagcgttgtaatacagcccgcatcatcgtacatgacacgtacctccacaccctgtttcaccttatcgatcagaatgtccagaatggtatcccacatcacaccgggggcgattatgaagtattccataaaaatgaagctttcagcctttttcagctcctccaccattgccttgaacttctcctcacctaccggaaagtaggttgtttccgtatgattgtagatgggaaagattgcattcttccataaatagttggcctgcttgtgtgcaagcggatcctctgcctccagagcctccatgatttctgtattctgccaggaaatttcctgatagttttccagtgcctcgctgtctcgcttgcgcagctccttgggaaccttctgtccgccaaacagcagatagatcagtcctccgaagacaggtacagccatgatcagcagcacccaggtcagcttataggtcggattgtcatttttattgatgatgtaaatgctcatgcagaagcttagggcgatcagaataaaataaatcgccacaaagtattcgctgagcttgaagacgataccgaaaaatacgaacagctgaatcagaatcagtatcgatacaatcaaaattttattatgtaaaagggatagtagtttacgaatcatgcagctccctccttcttttatttctggttatgcagatattctttcaccatggtgatattgccgtccagtgtctccaactcaatatcacgatccttgccggtaccggttccaatgacacagaggcttcccgcatcatccagttcaccgcaggaaatgacaacagcttttttgaaatacgccatggcattctgtgtacgcatttcctcattcagcttgatgacgtcgatggatttctttttcggatgatatttggctatttcatttgccagcttacggttctgcggattgaagccgatctgtacgacactgccctttgcgatgcagtccagacagatgagcgtcggattcttccccgcatttgccagatcctttgcggctgcctctgcaccgataaaacgcatcttgttcttatcggtaaacagaaagcccacctttttgcgctcatccctgttcagtccctttgcgatttcaacagctgcggctattgtcgcagaattccggttataattatgggcattgtgaaagccgtgcatcatccagtacatcagcatgacagtcagcaggaataacccaaaggatatcagtgacgccagtcccgttgaagtaatcagcggctgcaacccatacagacctccgaaaatcagcgcaaagaacaggaagatcggaacataggttgccaccatggtcttgtttgccgtcttggtgccgtcaaaaggaaaatacagcacctttttccaaaactttctttccggtgtgtcataaggaacaacaatgaccgtcttcatctgcttcatatttccatataaataattatgcgcatgtgacagcagcttttttccttcaatcatcgtgggttcataaccaagtgcgtgaaaatcctgatgcaatgcttcgataaaacgcttcttctgtcttcgactgaaacgtgtaccatatgtttttgtatatttctccaatactgttttatccatataagcgcctcctgaaactaatatttttattatactagaaataagagaaaaattacagtgaatcagggatatccaacgaaaaagaggacactttttctctgtatcccctttcatttctgctattacagaggcgactgcaatctttcgtgtattcggttattgcttacctgcccactgcaattgccttactctaaatgacagagatgcagcatggaattacttgctgtaactaagtatgcagaaaagctcacatcatggtgtgagctctctgtatataattatctatcttagttttcagatttgccttgcttccttcttcgacgaagaacaacagcagcacctccggcgagcagcgtcagcataccggctgcgccagttgatgtcgtatctccggtatccggatgctcagcatcaggctttgacggctccttctgtccatccccctgtggcttctcatcatccccagcggataccggctgcaacttacgatagctttgctgcaaggcctcatatgctttggctatagctgcttcatccgctgactcattcgccagcacagcctctgcctgcctgagcgccttaacaaatgcctcccaggaggctgccgtatagctgtcctttttaacagtcttcagaatagacaccaggttttgcagctgatctctatttgctgtaccctgtacgatttcaagtgccagaaccgcctgcttcagattcttcagtgccgtatccacctcactttgtaaagctttctcatttgccagcaccttctctgctgcggcaatggctttttcaagcgcggcatagctgtttgcagtatagccttccgctttgattttcttcgcagatgccacaagctccttcaaatccctcttgtcagctgttatcactgctttttccagcccctgcatcgccttttccaaagcagcagcacagctgttcacatcatcctgcgtggaagtttcatctgcatacgctgcagctgcacgataccatgccgcttcaaacgccttccagctatcctttgtatagtctttctccacataggttttggcctgatccagaagcttctgcagttcttttttatctgcccttaccgtgaccttcacctctatggtgtgcccggctgcttttccacgtaaggtgtacacaccggctttgtttacattcacatcctccagattccatgtgatcgtctccagcaattcaacatcgttatcgagcttgacacgaatctgtttcggcagctgatcctgtaatgtcttatcaccaaatgcaatcgttagcgccggaatcttctccatcaggcttacaacagatgcacccgggtattgtacatttacgttattaaagaccgttgttgaacggaatgtctgtacgccgagatagccatcctgcatatccacattgcttcgttccaaaatcttttcaccatccagccagtactccgatttaccggcaccgtcatacacaaccttcaaatgcgcctgtgttgctgctttggatttctttgcgggaatcacttttgtcacattccagatttcaccgttctggtttttaaacagcttggcaatggaactgccgtcatcctttcgctctatgtttgcacaaaaccagtcagctgacggattgtttctatcgctgacaccgaatacgatacctgcagccgtaccttccagaatatgcatatctgcttcgtaaataaacggtttgtctttgtagatccgggcatcatgaatcaaaaagctgtcaccgccggtattggagccaatcaccccatctgcagttttcgcccagattcctccatccagattccaatccggaatattggaagcaaagctggatgtgaatagtttgatttccacttccctttccagaccctgtgcactggctttgattttataggttccctccttactgccggaaacaacgatacttcccttttcttctttcaccagctgtaatcccggatcaagtgtccaaacgacatcaccgctttccatattcggatacatgttggtatcaacacggaattccgtatgaacctgtgcttcccgcggtgctgacagatatagctgcggtgcttccgattcagagcctgacttgccggtatacatggacttcatatcataaatcttcagctgatcaatcgtaacatctccatcatcacagaagaattccataccgatattgctgttttcctgatacatagcggtagaaatattggcctctccatcgtttccaaacgcttccacagcaccctgatcgatgatgatacgcagcttaaccttattcccatccagcggtttcagggtataggagaaattaccactgtttacatgatagcctgcatttctgccatccacatacatgttttgtgtttccctgttatatttgaaaatcagttcctttccatttcccttgcgcagcttaaatccgaattcctttgcggttcccagcgtgaattccccttccagatcatagcggatgccggatacgcctcgcagaatattggcatcggatgaggaaacctttttattttctgtctgatacagtatatgctttgtatctctcagcttatccacttcctccacgacatttgatgtaacgatatagttgccgtctgcgtcctgcttcaatccgtactcctgtggaagagactgcagtcccttataggttttgccatcaaattctatgaagtcctgcagccagctgattccaatctgacggttttttccggtaccgtcccgatagaatgtcattgttgcatattttccaaaaccgccccatggattggcattggaatcaatatctattttatctgattccgcagtccatttataaattccgttttcatccggtttcatacttcccaccacatagaatccggcacttccgttataaatccattttgtttctcctgttccgtttacctttgccggaatcaatccaggacactccgaaagaatctgttctccatttttgtatttcagcggctgcgacttttcccagtgaatcaggtcatcgctaacgtgaatctgtgctgctcccccggctgtcaccatataccatttatccttggcgtccccatcaattttaaacaccttcggatcacggaaatcatttccggagagcgtgtttccttcatttggtattaccggattccctgcatatttctgccaggtaactccatggtctttactggatgcgattccctgcgactgttttcctgtcttttcatcatgatatgtatagatagataccagcttggattctcccggcttgttgttgaataagccggatgtgttttcactatcctctacagcggaaccggagaaaatcagaccgtgttcatcaatctgcagacccagcggctgctgttcccagtgaacgagatccctggaacggacatgtgcctgcgactgcttgtagaagttgttgtttggcgaatactgatagaataaatgccagtagccgtcggtggaatcatacaccatgccgttgggatcattcataaaattgatctgcggtgtcacatggaactgcgcgcggtacggctgctgtgccagctcttctgttgacagccatttatttacagcaaaattgatattctcagaaaatccgtccttttcaatggtaactcccatgttcaggaaattcatatcaaagtcctctgctgtcaaggtaaaggtatccgtaaccttttgcttttcctttgtcaccttgttgttacgatccttcagcgtaatgtaaacatccccgctggattccggctttatcacgacacgatccactcctgccgggatatccataccgtagtttttcacattcggatcaaacgttggcgtaatcgtcacaccattcgttaatattttgaaatcactcagcttcgcctcttcaacagcaggaagctcacttgcggccttgtgattcagattctgatattcgatatttccatcccatgtcagcagtccgagataggattcccccttatgacggctgtccttttcacgcatgattccctttccgttggcataaacgtagatgtcttcaccaacgacgattaccttgatatcataggagccgtctgcatttggctccacatcgctcaaaggaacctcggcaatactgccgcctgtcggaaattcaaacagcttgaaaatattatgtgtgtaatccgcattgatcacataacatcctgcctgtggattatcgggattctgtacacggaacatcagtgccccggcaccctttttatccagattgttgatgttggcggaatactcgaagttttctattttcgtatcggagattgcaaagttatcaccgcttccctgtgagtgcatacctttttctgtgattttccagcttccctgcaaacctcgcagattttccagtgttgtatggaataagctatcatccgccctcacggttcgatctgtaaactgaatattggatagctctgcctctgtctgaaaggttaacactccgatatatccgccggcccaatcatccatatttccgctcatcacattttcactgccgccttcactggtcaccttgtaggtaaagtccccgtttgcctttatatccaaatccagatgtaccgtttttgtagaatcatagtcatttaatacctgcatgggctgataattatgatccccgggcactcggaacatgcgcattttgttttctccctcatgcctgatgacatttgcggctctccatgccttgctgggatcatttcgatctcccacaccgaccagcagtgcagcgcattgcgcatcaccgcttttgattgtcaaatctgcactatagtgaaaatcatccgcaattaccttactatcttcactcattgcaaaattgtcaccaccggtattatccagcatcaccttgccgccctcactgcgaacatgatcccccttgaaatttgtcaatgagacaggcgctgtttcttttgtatcctgctcctgattctttgttgaaggtacctgctcctcctgcggatcacccggagcagtttcagccattacatgaaaaggtactacattggttactgccatggagcatgacagtaaggctgtcagcattcttgtcgtttttctcgtcatacgatctctccttttttcatccttcagacatctttttgatgttctgtttaaagtatatcgaaagagaaaatgccaacccagtgtattttgtaatcacttacattgacattcgttaaactctttgtagctaattcctgcgtggatcctcccatatcagcaggcatgccgcagttttgccccgctttgaagataccatatcgccagctgcgtacgatctctgagctgcagcttctccagaatgatacttagataatttcgtatcgttccctctgtaaaaatcatcttttcagcgatttcacgattggacatcccctttgctatggcattgatgatatcccactcccgtgcactcagcttccttacacactgattcacgcgcttatggtcctggttctccatcttcagccctttttcagtatgcatcatatgaatcatttttgcaccgacatacggattcagaacactgccgccctccattgtggtttcgatggcatatttcagctcaccgagtgaaacccctttgaggatataaccgttggcaccataggcaagtgccttcattacatattcatcatcaacaaaggttgttaaaatcagaacacggacattcggatatttctctttcacgatacgtgtgcattccacaccgtccataaccggcatacgaatatccatcaggatcatatcaacacgctttatctccagatgctgcaatacctcttccccatttcctacaacagtagtcactgcaaacccctcgatagagtccagaatgattttcaggctctcgcgaattaactgctgatcctcagctatcataatctttgtcatgctctttccctctcgctatctcaaatagtatacatttatgtatagcttgttttttaggcaatatggtcgtataatgcacaaaaaaacagcaaaagctgctgttttgtacgtatttcataaagtataagtaaatgaatacctacgcccaaaccggtgatccactccgggttatgagctactgatttttcaatcattccactgacagccatcaccgttataggtaacacatcggatacttccctttgtatatccgattgctatcgcatactctcctatgctgtttcgatccaatacctccttccttactcatcaggcattacggcgtattatgttttatcacttcctattttaatgcgcttaaaagtagacgtcaattaacatttgtaatcggttacagaagacagctttatttgcagatgctgcggcatactcccatcacatattccatatacgaatccgtgtataaaaacacccggctgggctaccgggtgcgtctcatcatattataaggtaatttctatcacattttcgaaagggttattataagcacggacataaacgagcggtttcccgctcatactactgattactgactccacacggatgatgggagtgttcatcttgattttcagcagattcgcaaactgaaccggaaccagcatgggtatgaacttttgcgtaacacgtccgttttttacataatcgttcatatccagcagatttttcagatttttcatatctgcatcggatatctggtttcgaataaagaagatctcctcaacgctggtcggcttggaattgacggtattcagccgaacaacgctcaacacctgatcatcctgatcgatttccagtatcggtgcaatgtctgcggcatcctttacattaaaatacatgacgatgaactcactgatttcttcctgcagcatttccgcagctgtattcttcttcagcagcttgcggtctgcgacaaaggttcccttgtttttatcgcggtagaggaaaccctcatcaacaagctcatcgattgctttacgcacagtcatacggctcgcatcgaagcgaaccgccatgtcacgttctgaatcaataggtgaattggcagccttatcttcaatttcctgcataattaggtctttgattttccgatagataggagttgccatagtttcacctctttcctgatactagcgcatgaagccgaaggatttccatggtttgatataatccagcagcatgttctcatcctccggtatatgaccgatgacattttttcttccatcattcggcatatccttcaacacaatatgcaattctcctttataacgggaatattcatcatttacaatgacaacatcaccacgttttaaatctcttgtattctttggcggaacgctttccttagcgtaggtaacacgcggcatggtgcttctcgccatatactcgctcatatctccacgaacaaaatgcgggtgctcgtaaaggatcttttcttctgtcgggtgaagatccgcttcaaaatcaatcttgaaggtaagcttaccgggatcaatttttgaaagcgtagagagctcttcctcactcgcataagcatttgcgatgatgacatcatccaccagtcttgtggcaaacaaatgtcttgcctgcacatcgattggcaggtcacggtgtatttccaaagtacacagaccctcattcaccggccatgggccataggttccctcttcctgagaggatacgaaggcagcgactttaatattcaaatccttaatgtcctgactgcatttttcaaaatgctcatagctgattccgctgtagcgctgcggataaaagttatgacaggtgatgatattatccagctttggataatggctcataatattgtccagatatttcgtacccagacttgcgttgatttcgattttcaaattttgtggattataggtcatcaaagcttccttcaatgaatcaaatccttcatccagacgaataccgtcagcatgcatctctgcgaaaaatgacagatcatcataagaaacatgcagcttctcaaatacaaacggcgcaacatccaggatgacttccattccataggaatgtgcgtggtcgatcaattctctgaattccgcaaggatttcctcgcgttccttttctacactcagcaggcaggtaaagattcgtttgaatccgtattttgcggcaagtgtcacatatgctttatctttatccagagttgaatgctctggataaagagaaattcctaatctagccatgattagctcctcctttgacaagcagccaatactattacgattcggttgcttctgacttctcttttgcttcgttctgaatgtagctttccatgttacgcagcagctttactgccttctttttcgccccgcggttatagaagaaggacataattttaaaattcacgctcttcgcaccgctggctccggaaaaatcttccatatacgttacaccgatatgatcttcatccagctgttcaatttcataggaaattgtattgataccctgactgctttcgaatttcgccttgtaaatccgcggagcttcaaaatccgtaatcgtgaccttgacctttccttcacgcttcatcttgtttttcatatccttcgtgtaggaaaaccctttgtgaatctgcttcggtcgaatattcttacccgttgatgctgtgatatcgtatgcaattgactctgcgattttatcgaaaaaaacatccgcattcacatacaatttttcttctactttgatcatgtgcttctccttttatttctttttaacgttctttttgtccttgtataccataaaggctcccagacataaaacagtgacaccacaaatacaatacaatattttttgtgaaaagtcattataagtttgagaatacatcatgatgatgcagccgattgttacagcaaataagccccagcgtgtcataaatatcacctttttcctatgttgttcgcttttttattttgtagttacctgaaagtacattacgctaccgattggtgtagccttgatggttttcttggcgattgcacatgccttgtcaagatcctctgtgtttacgtgaaatgcaagcttgattcccgtttttccctcatatttgaagctgacgccttcctccgttgtcttctccagcagatcaataataaattcctgatttaatccgcaactgatgtatatcattctgttcacctcttgtttcccttatttttaattactttttgatttccttatataaatccatgaattcctgagacaggattttaaatgcctccgcactcatcagctgatcctcagcatgtgtcagcagcagcgtcatctgtgtggcttccccgccggcttcctgctgaatcagctttgcatgggaatggtgtccctcggtgaaggattcatccccctgcttgataagctcctgtgcctgctcgaaatttccggttttcgcttcctgaatggcttcgatgtaaagtgaacgtgccattcccacgctagagataatttcaaaacagatcagttctaaaccttccatattgtcctccttatagtaagcaagggaagagtaaatatcctcttccctttctatttacttttgttgctatagtttttattcttctacgttgttcattctgtttgcaacgataacaaacggaatccagcagagcactgctacaaccaggttgattgcggcgataactccggccatcagactaccacctgttgccaggattgcatagattactggtggaactacccaaggtactgtgatgaataccggtgggatcagtccggaagctgttgcaagataagcgattgttgccagaataaccggtgtaatcagccaaggaataaagtagatagggtttaatacgattggcagaccgaagataaccggttcgttgatgttgaagcagcccattggcagactcagttttgctactgctcttgcatcgtctctcttggagaagatcatgatggcaatcagcagtgcaatggtacatccggagccacccatccatacaaaggcatcgaaggaaccacgtgtccatacgaacatttggtcaacaacatcattcagtgattttcctgcagccatagcagtattgtagatgtttgtattgtcgttcagcaatggaatatatccaccgtccagaattggagccagtacgtttggtccgtgcagaccgaagaaccagaatacctgtacagcaaatacaagaatgatgatagcgccaagaccctgtgacaggttctggaatggaatctgcagatactggttgatcagctcaggcagaccgtttcctaagaattctgtacataagaactgaatgatacctgcagtgtagatagcgatggtacccggaataattgcagcgaatgctttggatactgctgatggtacctgctcaggcagcttgatggtaactttcttaatcatcagtttcgcataaatgataacagaaaccagaccgataatcaatgcagagaacagaccaccggagtttgtccaagcatatggcaggaagccccagccggtagcattattcagtaatatagcatctttcgtgtcattcaacgcaacatccagtcctgcactctttaatgtgttcagtgcatcaactgcaacatcaggaagctgatagttgaaggtagcgctctgtgctaagatcgtaacgaaggaagccagtgcaacaagacctccagcaagcgggttcacatcataggccttagccagatggtaaccgaaggaaaatgcaaatgcaatggccagcattgccagtgttccccaccatacatttccgttgattccaatcagccactggaatgtttctgcaatatgccagtccggcagataattgtttggcagatcacggaagaatacgtttaataatgtagcgacagcacctgccatggtaattggcatgataccgatgaatccatcacgaatcgctaccagatgtttctgagaaccgattttcgccgcaatcggcacaaaatgtttctccatccacgctgtgaatttttccatttttctttctcctcctaaaaatgaattattttacactgtccggtaaaaggagccacctgttaccgatagtgacaatgccattgtgagggattttacatcccaagaagctttaacgcctgttccagaaccttcgctccgttcatggtgccgtatgcctgcatgtcgatgactgcaaccggttttcctcctgcaatcgccttcattttggattccaggaaacgaacctgaggtcccagaagcataacgtccattttttctacattgttgacagcatccgcatcaccgacagcccatatttctgcttcgatttttttctctgccgctgcttcctgcattttcttaaccatcatactggttgacattcctgcagagcatacaagtaagatatttgtcatgagttttacccctttctagtggtctataccacttggtacactcatatgatacaacacccctttaaataatgcaagcgttttctttctaaatttctaattttttctgttcaaacgccgcagacaatctctgaaaaaagcaaataaccctttatttatcgcattatttccactttttattttttaacacaatttgtgattgctgttgcagtcttgtgatatttttttatgaaaccgcttattcttatggtttataccatggtccaagtggtctaatccacatggttttaagcttataccatatagtacaaggatgaagatgtggaagcagcggacaagcatagctgaaacgcacttgtttacagcgctttttccctgcacagagcaaaaaaaagacagcagatccaatacatgccttacctgctgtccgtgaaaatcatcctcttgtccatccctgctgctgttagcgcatatccttcctataagtatcaggaagcctgctcgccttgtgtgaaatcaaagagagcattttcataatcctttacaaaataacggatattttttcttcccctgcaaattaccgtatggccctccgcctccagtttttccttctgcgcactcacacctccgggatatttggcattcagctctccgttagccttcagcgttctccagtagggggttggatcatcccttcgctgaacacttgcccatgccgcaatggaaacgaaaataccggcagtgatcggctccgtaaaatccgcatgactcactcgtgcgaaataatcacgaagctccccgacagttgtcaccttgccgaagggtactctgcgcataagcgtgtcatagtcgataggcggtgcaaaatacatacgactgcctccgtactttttaatgctttcggtatctgtaatgattttcatctttggcatatccttgctgtcatgcagcatagcgttgaaatcctttttgtcttcatttgccatggttgccacctcctgcactaagcataatacgttttctttctgcatgcaatgagacggtttcacaaatacaatacataacgctccatgattcatccgttattgcatagggtgtaaacgatgagcttttacaatgtccctgattcatccgcattgggttctgttgtccattccttgttaaaatcagatccgcttatgattcttcgctgcccgtttgacttcaaaagatacatatcttcatcaggataataacaggtatcctcctgctctaccgtccctatgtcaagtagtatcaaatcggtatcgccaaaattgtatatggaatgcgcaatattctgtccggagggctttgcgaaaaaatcaccctttgtaacaggacagcttttatcattcagccgcacagtcccatttccggatagaacaagaaagaactcctcctgctgggaatggctgtgatactttgtgctgaagctttccggcggaattcgatcaatgttcacatacagccgttcgctgcctgcggctgcaccaattgcttttgtaatgagtccatgcgtgtcctgcgatataaactcctctgctatttgatccatatgctgtatcattattttccattctcctttatcttaccgcctattcagaaagcgctgtttgccgtcattctccgtatcggctgaatcgcacggcatgacatatgccatcagaacgaatgcagagctgctaaatcagtcattttccttcctatccatgtatacagacagcctttgctatggcgatgttccacagtcatatgataacatccctgtcttcttcatgcaaatccgataatccgtttgcgctgctttcattgctatgcaaagaaaaagatacagacctcacataactattctgcatctttcccgctgctattcctctaggatatccgcgcacatctgatgcgccatcgtcgttagaatgatacagcagctcgtcgctcccgcatccagatagccgcggcttcgctctcccagtcttgctgctcttccaatctttgccacaagctcctttgtgtgttccctgcctgcctcggctccctgctgcagcgcacacaggcatgccgcatagcttctgccttcctgcatcgcctgctcatatgcccttatcgccggtgcaagggtgtcaatcagtgttttatcgccttcctttgcccctgccagctcctgcaagccctgtaaggcatcctgcagtgcttttaggaatacctcctttgtgagcttctcttcctgtttgcacgctcttgcaattcttgaaaacatcgttccgtagatcggacccatgcttcctccgatatccatcaccagcgtccgcgagatcgtcttcatgctctcggaaaagctcatatccgcacgaagccgctccctcgccatcagaaaccccttgttcatattgactccgtgatccccgtctccgattgcaccgtcgatctcactcagatatgctgcattctcgtggatcgcttcacatatcgcttccgctatcttcacattcttctcatttcggatatattccatcacggtctcctcacctgtgtcagtcccacacatgcacaatccatatccagacattctttcaattcttcatccagcttcatcatcgtcagcgttacaccattcatctccagtgacgtgaaatagttccccacatacgaacggtatacccggatacctgcctgctgtaacagctcctccacctcatgatagaagatatactgctccatgacaggcgttgcccccagaccgctcaccagtaccgccacctcatccccgctttgaaacggtacatcgcggatgaccatatccaccatctcctgtgccatctgcttcgcggaccccagcggttttacacatacgcccggctctccgtgatgtccgattccaaactccatcgttcccggctcgatctggaagttcggctttccgtttgccggtattgtacacggtcccagtccgacacccacgcttcttgtattctcgattgccttttgtgcggcagagatgaccgcatccagatcagctccctgtgccgctttcgctccgccgaccttccatagaaagatttcccccgccacacctcttcgcttggtgatgtcttccttcggcgcacttgccacatcgtcattcgccactacggttcttacctcgatgtcatcatcctctgcaagctccatcgccatcttcacgttcatattatctccggcataattgccatacagcactgccactcccatgccctgatccaccgcacggatactgtcatagaagctcttggctgtcggtgaggaaaagatttcccccacagcgaccgcatctgccatatgttctccgcagtagccgatgaaggccggtttatgtccgctccctcctccggttacgatacccacctttttctgtttattgaaggaattgctgatgacgactctgggattttcttcatccacatggatgatatcccgatgacatttcgcaaatcccttcagcatatcctctacgaccatgttgggattattgatgattctctgcattccctgcacctccttatcttctgtattcctgttcgatttccatgatacgtgccaccttttcagcactggcaccgccggcaaagctgcattccagccagcgttccaccagcagccttgcatattgcgctgctatgactcttgctcccatgcacagcacctgacagtcattggatttgatgctgcgctccacagagaacagatcatgtccgaccgccgcacggatacccggaatcttattggcagtgatcgccataccgataccggtcccgcacagcaggataccgcgttcacagcttccatccgtgatacatgcgcacagcttttgcgcaatgtccggatacagggacggcgcttcatgatagaccccgatatccttcacctcatgccccagctgtatgatagtttccttcattgcttccttcaggcggtatgccgcctcatcacatccgattaccagcttcataagtgctcctttcctccctgcgagttgcccgcaagtaacatccgtttgtctcaatatatcctatcctttgctcctctgccggataggaagaaaagccgcaagcgattcactcacggccttccctgccagctacagcttcgtgattgcgaaaaccgtttttaccggatgattttcaaagttcaccagctgatacttcactcctgacgggataaagaaggtatcctccggctccagtacgaagctttcctccagatcgaccagattgactgttaccgggccctctacacaatacagtgccgcatccccttcatgggtatccggatcggagcatcttggtccatagccgcctgccggcagtatgaattccccaaagtgaccgtaatcattgctggtgataaagcgcatcagcatcggatgcttggttccatgcacattgttcagcttttcaaaatcccggaccgcatagaccgcaccggtttctcttgcttccctgggatctaccggccatgcaccgatatcatccgtacagccctgacgggagatatcctgaatctttccacgcatatccggaagtgtatcgttgtttggtcccttatagaacttcgtttcctcatcgcttgggatcacagcaggcggaattgactcactccatgccttcggtgtgatgaaatacaggatccttgccttctgatcggagaaattgtgacagcagtgccatgcaccctccggcatgaacagcccttctccagtttccagataagcaaactgtccgtttccgcttcgctgtacgaccggaccgttcaggatgtaataggattcatcaccgggatggatatccagcggtgcaaagacaccgcccggacccagctcatagataccgagcatgaaggtatccgtcgtaaccatcgtaaaggtattgtcagaggtaaatgcattgttgggtggatacagcgctgtggaatactcgctcttgcgaatcagcgtcggtttcttatcctctactttaaaggggaaattccccatgatatcaaatagttttgccatagtcctgtgtcctttcctattcttcagcttctactgcaggcttacgcagcaggatcagtaaagctgcactgactgcgccggcaatcagaagtgctacaataaacagaagtgcgttattcaatgcgaacagtacaaacaagccgccatgcggtgcacgcatggtcaatccgaatacataggataatgcacagcctactgcggagcctgccatcagagaaggaatcaccgtcagtggatttgcggccgcaaacggaatggcgaattcggtgatcataccgaatgctccggcaaacagaccgggtaccgctgcacgttcctcctttgtaaatttgttttttgcgaccagtgccgcaaccgcgattgccagcggaggtgccatactgccgataaagttcgctgccatcggcatgtagtttccggcatccatagcagcaagcgcgaaggcataggcaaccttattgcagggaccacccatatcaaaggcaagcatacagccctggatgatacccagcaggacaagatttccggttcccagagagttcagcatatcggttaaagccgttgttaatgcggatagcggtgtaccaataacgtataccatgatcaaaccgattgcccctaccccgatgattggaataatcagtgttggcagcagtgatttcaatgccatcggcagattgattttctttaacagattcacaaggtaaccggcaatgatacctgcaatcagggcaccaaggaagccggacccctgcatatccgcaagtgcaccgccgaccataccgacagcaataccgggcttatccgcaatggaataggcgacataggcacccagaaccggcaccattaaggcaaatgccttttttcctaaccagaagatggttgaagcgaagttcccatattcttccacggaattgggaatgtcataaccgccaatggcgaagcccagagcaatcagtattcctccggcgataacgaatggcagcatatagctaacacctgtcaacagtgccccttttatttcactaagtttttctttcatgacttttttcgtcctcctaaataacatactgtatgaattatttcagtgtttcgaaaatgatatccggcttctgaatcacctgatgcggtgtatgtctgacaatcttatccttataagcgtcaaagcgttctgccttactgattcccacgtcattggcaaaaacgatcaggtctgccgtcttgatatccttttccgagagcttgttttcaatccctaaagctccctgcatctccaccttgcacgcataccccttctttttgcattcctttttaatagcctctgcggccatatacgtatgagcgatgccggttgcacaggatgtaattgcaacaattttcataaaattcaccttcctttccgttcccattgtgttccttacgcacaattcgattgcagggtattgatagcctgaatgatttcttcatagctttgtgcatgctccagtacttcgataaattcttcatgcgtcaacagcccggccagtgtggcaagcacccgcagatactgatctgagctttgattagcggcaatcgccagcatgaagacatagcgtacatcgccctcctcatcatgggagcaatagcggaatgtctgcttgcagcggcagaagcctatccccggttttactacagcatcgcatttgccatgcggcagtgcaatcatgtttcccatataggtggaacccagggtttccctttcctccagcgctttgatatattgctttgcatctgtcacgataccggctgcctcgaattttgcggccagtgtttcaaacatggtttccttatccgtaaacggctcgacatccagcagaacggtatccctgatcaaaaccttcgataaatttacttcgttcataacgattcctcacccccggtgctactttccgtttttgaatacagtcagtactccctttgcatattctttcataaagcggtagctttcctcttccacctcatgccagaaggcttttccatcccgttcgttcaggtattcctggatatgcctgcttgcggctgttgccatgtagctgtaatagttgaccttggaacaacctgctgtgatcgctgcacgtacctgctcttcgtctactccgctgcctccatgcatgaccacgcgcgtttccttcggcattgcagcacggattgccttcactctctcgatatccagtagcggcggttccgcatagatgccatgcgctgttccaaagcacaccgccagtgcatccacaccggtttctctcgcaaattccgctgcctgctgtgggtcggtgaaggtctttttgatgctttcatgtgtccagccaatgcttcctccatgagagtcttcttccgtgctagtcataatacccaattcagcttccactgtgatgtttaaatcatgagcaattttcgtaaattccttcagctttgccatgttttcttcaaacggcagcgcactcagatcatacatgatgctggaaaagccacagcggatcgcacgcatgacgaagctgtaatcactgccatgatccagatgcacacataccggcacctttgcctgctttgcatactccaccatctttggaccaatgctttccatgggaatcagtggatcatgtacctgcgcatggtcgataatgatcggcacattcagctcctcagccgcatccacaaccgcacgcagtgtttccatattcggtgtgttgatacagccgatggcataccccttttcttctgcttccttcaagatttctttcatgttcactaacattttctatatatcctccttaatatgtctgctgtttatacgcccagcccggcggcaatacgctttaaattggctaatccctgtacagccagctcttctccggtatccgcaaatttacgccatatggcacagttcgcattcagttcttcaaagcttggatcaaaggattcaatgacacagggtccctcatatccgatgtcatgtaatgctgtgaagaattcctcccacggtaccagtcccgttcccgggataccgcggttgttttcacatacatgcacatagcccagatacgcttttccacacacttcggccgcttccctatagctggtctcctcgcggatcatgtggaagcagtccagatgcactgccatgtttccggtgccaaccgccttgcaatagcgtacgccctcctttgcagtattgatgaagtgggtttcaaagcgattcaccggctccacgcatattcgcagctgcggatgtgtttccttcgcataccgggcagcttcacgcatcgcttccacagaatggttccattcctcatccgtcttcggtttcccgctcagacagccccagccggcataattcacaccgccgaggatggtactgcctaattctttgttgatatccaccagtcttttgagagcctccactccgtttttacggattgcctcatccggagaaatcaaattcgtctttgcgtccagagtcgttgttgtgacaacctccagcttcgtctttgccatctctgcctttaccaaagcagtaggaaaggtttccggatgggcaatggcgatatcgatggtagaaaagcccagctcctccgccttggtgatgacccacaaatccttctctgaaaacacttcactccagataaaggtatctactccaaatctcatcgtatccctcactttctatgcggtgattccactctgctgcagaatctcccagatttccatttcatcccttgcattcttcaaggccttgatatttgatcgatcatcaatgaatgcatagaattgctggaaaaagttatatacttcggactgcgtattgaaatcaatggccattaaaaatacaatctcaatacgatcctcgtatgtccagttcatcggacgctttaaacgcatgacaacaatgccgctttttttcacatatgtcttatagccatgcggtactgcaatactgtttccaatagaagtcggtgttgtcttctcccgctcccatatcttcttctcaaaaccttttttcacatatcctttttcatagagcagctgacagcctctggatatgacatcctccttgcgcttggcattcacatcacacagaatcagcttcggatcaaacagctggaaggcttcatcccgatccgctacttccacattctgcttctctgtaattgcccggcttatcttttcaagatcgtcatcgctgatttcgcgactgacaagcaggacatttttcttcagctccagcggtacggtcgtaataatcaattcaaatttagtaatggagctttcctttatatcctcataatgcagaatcttgctgatggccagattttccacattgcgcattattttattcgcctgatacttggatgtatggaaatcggctgccgagataaacacggcattgaccggatgatccgattcatcgattgcattgttgatcagcatgacgatataggcgatatcatcatccgtgaagctgattttcaggcaggattccacttcctcgatcgttgtcagcgtaataccgtacaggctgggaaaacgatgcttgatatcctgacggaaatcgtaccgtttggatatggcgaaggtctcctgcgccttctttttctggataaagagactcacatcatggacaagtccctcactgatcacaaagcgcttgttggcgacgattgctttgagatgctccagaaactccctggtaatcgcatcaaagtattccatattgatttcatcatccagtccatggttgctgaagacgatgaactgagccgccatgcatcggatttccagtcccagataggcctgcagaccgtgaattgccgtatcaaacagattcttagcggcggtgtattgatcgttattgacattcagcttgttcatgatattcttttccacaataacattgcccttgcgaactctgcgcagcgtcacggcaacatattccataagctgccagtagtcggtatccgtgaatgtcatttccagatcatcctccacatcctttaacagctcctgcagatacaggatatcgaagtagtcatacatttccagaaagtagttatagaatttttctgaaatgcggtaatccattccctccggcacctgttcactgccatagatttcattcatgaactccttattattctccagaatcgcctgtcggatattaaactctccacccgccacaccgattcccatattgcgcttcttcacaatttttaaatcaaattttaacagccactgctccagcacctccaaatcctttgtaataacgttgcgtgccacgttcagttcctcggcaaacagctggatcgtatagctggaattgtattcaaacaagacatccagtatatattttttacggtaattataggatgaggaatgatcactgttctcctgtagcagctgtaaaacagcttttcgctgatgatcatccgcagataaccagacacccttaccggggatggaattcaataggacacctgccttctgcagtgtcttctttacataatccagattgtgcttgatgctgcttctcgaaacaccgatttcattcgcaatcacggacgtggtgatcggttctttttgttccagcagcagtcgtatggttttttctgtcatccggtcaatcacgaacgattcctcccttcgttgtatgcggtttcttttgcacctttatcttaccgtaaacgattcagaattgctatgcttcataaattcgctttgtgcaccatcttggtgcaaattgaaagcgttatcagcatttgcaccatacttggttctttttgaaaaatatgcaaaaaacacttgttttcccgggattattcaatttcataaaaaaaacagctgttggataacagctgcagctttactaatgtcgacttaactgaagcagaaaaacggacaagcttgaaatgaaaacctatagataaggcattccctgttgccatttcgtaggttttcactttcgcaaaggttttatgaaatgtcgttttacttactatcgataaatttaaccagaaaaatcttattgcataggacgaagactttgttatgtaggatgcacaaagacaatgatagtatccttacgtatttggctttatcaattccttaaccgctttgggaagcattccatacaaacgcttgcctgtgtggttttcttaataaaagaatgctcttgtaatgatggtgttttccgctttttctggataaaatcattttttcagatgtacttttttcttatatacatcgccgctatgacggtgcctgccctctgttatggaaagggaatcaaacagctaaaggagttgaagctattatcccgtcagacagtgctcatgctaaattcaaaaggatcaatgtatcgaaagaaacgatgtacctgatcccttttgcttatgctgataaaccgcagcttcatgacttctttgcgttattgtgtaagcttttgtgtgatatactgctgtgtttcttcatctgcgaattttattaaatattcatagttgtgtgcggaaatgtaatctgtgattccggctgtatccattgtctttttcaaaagatgggaatacagtgtctggtcatcatgtaacagagagctgatttccataaaataatagtccttgtattccagcgaaatcatatcaaatatctcttctatcgaactgcaggcctccagttgttgctttaaagcctctctgcgataatcctccactgtctttccttcctctatcacgatatcttgaaatggaaataccagctgccggtagtcctcccgcttttttctggcttttccatatgtcaacagatacttccatagatattccttatgtttctgtaaatcaagcatgttctcacctcgttctgttattatacaatattttatcgatatcaggcaacggtaagagctgtcattttgatacatccactaccttctgctgaaaatggctgtgtactttgggacatggagccctgcccctgcaccatgaaaagtctccctgctgatatatgccatcttcctttttctgtatctccgtgatataatcagaaaaacaaggaggcgtatttatggagaagaaacaatatgtctgcccgaaatgtggtaacacacaatatgaaagtgatcaatttcaggcaacaggcggtaatttttcaaaaatcttcgatgtacagaacaagaaatttatcacggtttcctgcactcgctgcggttatactgagctgtataaacaggagacagatgccggatggaatatcctcgatttctttatagggaattagaaaagctgtaacgtattgctttcacagtaatcgcgttacagctttttatatacagtactaatgcttttcaagctcctcaagctttctgcctattttgtgatacagccgcaaatataaaataaaaaccgcaagtatcaaaagcagaatcacaccggaaacctgaattcctaatgtagtaatggaggatgcatttacacccagccataaaaaggcgagaagccctatgataaaagccgaacaaatggccagcatggtaagcaacgacctccagcttgtcaaaagtcgcttatataaagcaatccttgacgtacgatcactgaaaatctccggttttgtgccagtttccatctctgtacgaaagtaattccacacaccattaaactcgcctttttcatgatagatattgtcccatcccgcctctttgtaattttccacatactggtcagggtcacgaatatctttttcataatatccaaggtgataataataatttttcggcgtatcttttttaaatatgtattgaattccgtttttccttacgaaatgaagccccttctctgacatgctgtgcagatactctgcttcttcatccatatcggaaacaaaaaacagcttatactttttcacattctcagcaggagctgcgctcactggcttttctatttcctgcgtagcttgctgtggcttgccgtccgcatccgcttttagctcttccatcattttatccagactgtctgacgcaatcagctcttccttattttcgtcatccgaagaaatctgatcaagtccagattccggagttgtgctttgttcttttttttcttcactcatggcgtaccctccatttcctctgtatcaataccgtaatgctattgttctgtcaaaaacagctgagcaagctttgaaaatgtatccacacttgctgcataatcatccgcttcaccgaatccaaaggaagcatagatgaatggtatccctgccttacagcaggatatctgatctgtctttgtatcaccgatataaacaggctgctgcaggtgattgcgttccactatggatttcagattttcaaacttcgctttcccagttcttccggagcattcataatctctgaaatatttctgaagatcatgtacagcaaacattgcctcaatataaccatcctgacaatttgatactatatacaatggataccgcgctgacagcttttccaaagtatcctcaacatggggatacagcctaccgccatgctttcgcaaatactcacattcgaattcacagcaggtttcgataagtcgcatccgcttttcacaggatagctcaggaaacagtcttgccgcgatatcctcattcaaaagacccatcacagacgcaagcatgtctgctgttataactttaccttcgattttttcccgctccagaataaccgtatatgcttcagcgattctctgcgtcgcatcccagagtgtgccgtcaacatcaaaaataattccatctgttttcatatgaacctcttctatcaaactgtaaccgttaattatcgtagcatattttacagaaaatggctacactatttcatgcattcgcagcaatccggataagaaaatttgcataccagaaaaactcatcatggactagatccatacggataatcgtatgctcctgcagggacagcagttcctgagatagcggcttcataagcagagtgtcctttctgtgtgaaaattgtcttccgtaatgcagcgttaaacgactgctttttatttgaaaagaacgcggtccccatgtactcgatttcccataggatgtttttttatgcgccagctgcctgttgaacattttcaaggctgtctgatacagcaaccagcgactgtgaacctcaatcgcgtcggaaaagcataaatccgcatatctaatgctggatgggtgcttgtgcagctgatgaatcaaatcctgtaaatccgtgtgatagacctcctcatatgcaagcagatgctccttttgttctgttgttgcatgaagtcttattttaatcgttcgatacataactgattacctccttttacccttatatacggatggaagaggtgaaattcctaaaatttattaaatttttttattttattattttcataccttgcagatcttggagatgatacgcatagcagttataactctttgcttttacagagggccagaaactcatcatatgacatcaccatatgatggatagctgcaattatttcttctctcacttcatttttcagcgcatgaggttatgtgtgctatgcaggatatggatatacatacttatacaaatttctgttttgaaggatgcaaaaccacgcagtatctacttatgtatgcatattcctgagcaacgatacggcagttactattcaactgtcttagactgagaaaacacgtgcactactagagatatcaccgttgttgctattgcctgtatttatatgattacagtatttgaatatattatgatgtgtggacaatagtaactaaccgggatgggatatatgcacaaatttaaaaattaggtatggacttttaaaaacgattatgatatacttttatggcagtgaaataaaacggttttatctaaccacttactgctgatcagagctggagtagtactcaagaggctgaagaggtgcccctgctaagggtataggtcgggaaactggcgcgagagttcaaatctctcctactccgccattaaaaagtgaaacatcgcaattgcgatgtttttttatatacagatcgtagatgagaattgaacacagattctatggtgtcgacttaggagtagggcataggaaacggttaagtgaacaggctatactgtgaaactccaggcattccaacagctgtgcattcattatgaagcgccctatagaaaaaggaggctggataaatgatcattacatgaaattgatcaaaaccaaacctcgttttcataatatggttccgtttaagaaagaaatgttttttgcgatccctgcttctgctaatcctcaaaaagtacggtggaaagataacgttctgcagtatctggcaaaagaacaacaattcgctttcctgcaaacacatcccgtttcgcaagctgtaaggccgcatacatagctgctccactggaaatgccgactgcaattccctcttcctgtgcaagtttttttgctgtggaaatagcagcttcatccttgacctgcacaatctcatctacaagctctccatgatagttttttggtataaatcctgcaccgattccctgaattttgtgcgggcctgcagctccaccggataataccggagaattttcaggctccacagctaccatccggatatccgcattcttttctttcagataagctgcaactccactgattgtgccaccggtgccgacgcctgcgacaaatacatcaagctttccatctgtatctctccagatttcctctccggtatgaagataatgagcgttgggattgtccgcgttttcaaattgctgaagaatgatggaattcggtatctccttatgcagctcctcagctttggcaattgctcccgtcatccccttacttccctcagtcagtatcagctcagcaccatatgcacgaatcattttcctgcgctcgacactcatagtttcgggaagaacgatcattaggcgtataccgagagccgccgcagtcatcgccaaaccgatacctgtattaccagacgtcggctcaatcagtactgtgtctttgtcaagccttcctgcctttttagcctccataatcatttgatatgcaatgcgatcctttacacttccgccaggattgaaagcctctgttttcaccagaatctctgcctttccctctttattcaaacgatgaaccctgatcaatggcgtgctgccaatcagttcggttatgctgttatatattttctccatgtatttgttctcctttttcttatccatcttcttttgttattttatataaactaaggcgaggtaataacatcgtgtcgtatgatgaaacttgtcagcaatatgaattttcagtttcacgcttccatctcctatcattttactgggattatatgttattttcctttgattgtcaatgcataagattcaatattcctataatttttgtatgatatgcttgtctttttgatatatatcaactaaaatataagataagaattgatgggagagatatgatatgaaaatttctacaaagggcatatatgcactggaagccatgattgagctggcctcaagaaatactgcatgtgtcagtattcgcgatatagctgatgccagaaactgctcggtgaaatatctggaacagattttcaaacaattgaaaaaagcacagctcctgataagtatacgcggcaaggatggcggctatcagattgcaaaggatcctgaagaaataacggcaaaggatattattctggcagttgaagagaaactggatcctgttgtatgtctttcccatacatgtactcgctccggtatttgtcggacacaaccggtgtggatgggtatgcaggaacaaatctacaaagtccttgagagtaagacactgaaatatctaactgatatttatagaaatgaggtgagtgcatgaagctgtcaacaaaatcacgatatgcggcaagatgtttaattgatcttgctatatacggtaaagaccacccgctgtcaattacagaaataggtgcacgtgaggaaatttccgaacgctatctggagctgatcttcgcaacattgaaaaaagccgggttcatcgcaagtgcccggggaagccagggtggctatcagctgatacgtccgattgaaagtatcacgatttatgatatcattgcgttgatggaaaccaatacaagcatcgtcaacacacaggatgaacgagatccaatgaagagaatactgatgcgtgaggtctggtctttgattgatgacaatctgaaagcatacctttctgacctgactattgcggaattatcattatcttaaagagatgcacgcagcttcttttttaaaaactccacctttcataaagatggagttttcgtactgtataaacagcacatgagattcaagtccctggacgtttctttatgaagctgctatgcagtctcaggtgcgccctcaccaatccctgaacagtaccaatggtattcagggcagactctcattcagagaatctcaggtgcatgaagaatattcatagcaccgacaacatcacgatgatggtgaaaaccacagcggcaggtataggttcttcctttcacgttattgatttttccacaggaaggacagcgcttgctggtaagtcttggattcacgtaacgaatatgtattcctgcaagctttgctttatacgctataaattgctggagacgctgataggaccagcaaatctgttcatgctttgaaaattttttttgtaaatagtacagcttttccagacagataatctggattttctgttcaattgcaaaatttacaatctcacgcgcaaggcagtgatcgatatagcgcttgtaatcattcagacgatggtactgctgtttctttttaccctgcgttctctttataaattcatctgctctttttctgatccttcttgtgtgataccggatttctctgccgttcccgacaaatcggattacaccatcgcaggtataacaaactgccggacatcgcataccaatatcaactcccatttttctttcctcgttcagaattccggcagtattcggtgtatgaacacaaagcagcagataagcgtagaaatcgtgatgtatttctcttatatccgcttttaccaattccccactccataaccgcttccactgctgtttatgtatttcggttctgatacgcagttcaggaacaagaaagctttggccaaacatgaatacaattgaattcttctcaagctgcatagatttcgccatacaggaaaaactgctgggatacacggccctatgctgcagtctgcgctcctcatacagagtcttcgcatagtgcagtacctgatttttggaataaaatgcgatatctgaactgacccatttatatggtataaatatgacacttcccagcttttgatatcgtctgatgatgcgctcgacctcgtcctgaaagcgcctgctgtatgcacggagtatctgcttttcatcatgcgtggcctgtaactgcaatttaatggtaagatacatgtaattttcctcctttcactatatacatacgattaaaatttttaaaactcctaaaaaaaggcaaaaaaaacctatataaggctaaaaaatataaactatctgaacattgaacggttaatgatacagtaaatacaattttcaacaaatcttgatcaatttctaagtatcatagcagtctaagttaaatataatagcaaatcttaaacacgcatataagctaacctgtatgcactgcttctcttgaacggtccagtcacttttcgatctgcctcccgtctcaaccatcaacgcgttgaaatcgtgggttggctcgcacgtttgtggttaccatgccacacacagtataccgatcatgggttcgctgtttatatacacagccggttatgcattcagctgaaagcctgccatggcgaaatcgggttccctcatctgctcctgaaatttgttggtcaaaaagttggcaaactttttgatagcgaaaaaaaagccgaaatctatcggcttttatctttctatggagcagatgaggggaattgaacccccgtatcagccttggcaaggctgtgttctaccattgaactacatctgcataactggcggtccagatgggactcgaacccacgatctcctccgtgacagggaggcatgttaaccactacaccactggaccatcatattcaaacacatttcaaagatttaaatggcggtccagatgggactcgaacccacgatctcctccgtgacagggaggcatgttaaccactacaccactggaccttcagcttgtattaccacaatgcctgtatataataccacgaaacttcattcttgacaagtaaaaaatgaaaaatttattgatttcttatcactttttcctataccgatcatcgtcatcacctcctcagcaataatgaaaaagagattccaaaaaggaacccctcatgtattcatatactcaggcttacccgaattgcccgattgatcttttccagtgttttttcatccaatgtacagatccactgccccaatctcttcttatctatggtacgcagctgctcacagaggatcatagaaacatagctcagtgaatcatcactaaatatgacgtgtgtgggaattggcggctttgacatcttttttgaaataggagcaacaataattgtttttgaatagcggttacctttatcattctgcacgacaacaaccgggcgaacgcctccctgctcgctaccgacaaccggagaaagatctgcatagtatacatctcctctccttatcattacttcatcacagccacctgcatgctcataatcacctgcatcatttcctccgggctcaggtcatcagaaaatacagtgaactcgacattatcatacaccgcacttagatggtttccatcatagaatcctaccacatccaacgcatccatcatttcaccgggcataatcacagtctgcgtctcctttacactttccttctttgtttccacaaccgtaaaattcttatctcccgtatactccagaacatgcttcgtctgtccgttcgcattcatactgctgatattttcaagcttggcatcatacaccataaccggatataaaggcaaatcggcagccgttattgcagatgtagcctttgacttttccagaacagtcggtgccttgaaataatcatccttgatttttgcattataatccgactttgtaaacacaattttaagctcagatgtattgtccttgttataaatctgcagccacttcagcttggaatccttatcaaacatgatttcctcatgatcgaagttcttattatttggataagataccttgcttgtcacaagataaccgcccttctcctccttaatcgctgcatcctttcccttcacaatatctgaaattgactgcaatagatacggttttggagagttcatcggccagtctccctcaaacttgaaaatctgattcagacttggtgttactacaaaaactccagcatcatttcgaagaataatctgttcctgattcaactccttatccgtcaatgtcaccttgaagaaatccttatcggccttcttataaccgacctccacagcatatgtcttcacatcctcacccttcgcaatttccatattgccttccaggatataggaattcatatcagacatctttttctcaaactgcttatcaaaggattttggtttcattgcgaagatgagtgcgatagccagaacgacaataccaacgcctgcaatgatttttgatttcatattaaatctccctcctgctcaccctactttatgccaggatttccggaatcattcataattgaagaatattttcataaagtagaacaggtgaagaaaatgaaaaaaacacaaaaaatatgtctcatccttacgattctattctgtctgaactatgctttatccatgctcttgggctttcactatctgacacagttgataacctcgattccatggctggaaaaactgattgcgtttgtaatcggtgtatgtgcctttattgacattctcgcattccgtcctgaagaatagaatcgcgttagttcgccatcccttcaaaggaatgcaaatgctcatgtaaaccaaacatcagacaagcatgaagactctatgtaatacagattatagattaaaaaaaacgataccaaataaaaagctccgattacagcttcggaacttttcagtaattctatgcaggactctgtgcagcttcttccagttcaatgccgggatctgctgtcagatcaaaatcaccgcgcacgccatgcgtgtacgcaatatatcctgcaacggcaatcattgccgcattatctgtgcagcaggacaatggaggaatgatgaattcaatatccttatatttatcagcaagacccttttccaccttttcacgcagacaggaatttgcggcaacaccacctgcaagcaccatctgagcaggatgatatttttgcaatgcatactccgcacgctccagcagggcgccaaacgcggtttcctgataggatgcagccaaatcagcagcggcaaaggtttcattttttcgcttacagcgatcaatgaactgcaatacactgctcttcaggccactaaaggaaaaatccattggattctctgtttttggtcttgccagcttatacatgggcttgccttccttagcgattctatccacataaacaccacctggatacggcagtcccagcactcgtcctaccttatctccagcttcaccaatagcatcatcctgtgtagtgcctaggatttcaaagctccactcatccttcatataaaccagctctgtatgtccaccggataccacaagtgccagcaatggaaatttcaaatccgtaatcagccgatttgcatatatatgtccggctatatgatgaaccggtaccagtggcttatgaaatgcccaggcaagcgtcttagccgcctgcacaccgatatgcagacagcctaccagacccggtccctgcgtaacagcaaccgcatcaatgtcttccatcgcgacgttcgctttatgcaatgcctcctcaattaccatagatatgttttccacatgaattctgcttgcaacctctggaataacaccaccaaattccttatgtacatcaatctgtgttgcaacgacattggacaaaatctcttttccatccgctacaaccgccacagctgtttcatcacaactggattccacagccagtatgagtgtctgtttcataccaaattacctcccagggctttgcacatcacaatggcgtcttcgccattatcattgtaataccctttacgtatattcaccttcataaactcataggaatcataaagacagcgcgctgcttcattcgaggggcgcacctccagcatgattgtttcacactgttcctgctctgccgatgcaatcataaaatccatcagacagcggctgtaccctcttctctgaaaagaaggatgtacagcgatattcgccagctgacagcactcaaatgttatccagaaatcaatgaagccagcaatcttttgattctcttccaatacataaaaatgaccaaattcattctcatgcagctcgtaaagaaacatttcctttgtccagcgactgctgaagcaaatctcctcaatctgcatgatgcgctccagatccctatctgcagccttgcggatcatggctttaccttatatgcatccgactcctttaaataacgcggagttaatgtatgtacattctcaatttttctataaaacggacgcaatgcgatgaagttttcaagaaactttggttccttcgcctttagatcaatcagctcacagtctccaaacagctgataatccgcttgattcagaagcaaacgaatttcatccagtgtcagaatttgttcctcttcaacaaatttaccaccctgtaaagctcctgtataagcacgctgacttcttgcatccagcatgacaaatgcacgctcatgaactcctgcataaagctgcagagtggaaacagcgtatagcggtatatgctttctggtacataaaaccttcgcaacgcacattgctatccgcacacctgtatagcttcccggtccgtctgtgatcacaacctcatccacatcatcactgtcccagccggcttccttcatcaggcgcatcagctctggaaatatggtctccgattgtctcttccatgataaattagcagtgccgcatatcatacgatcattttcatacagaccgataaccagatacttgtgcgcactgtccaagcataatgttttcattataacgcctccacaattttttcatacactttgccttttggatcaaatgtaaacattcgtttttcatcttccccctctactctggtaatatcgatgtgtaatcgctcctctggaagctgactttcaataaaatgcggccattcaatcacacatacaccatcatcctcaaaatactcctcaaatccgagatcctgagtgattccctccagccgataggcatcaatatggtaaaccggcatggaagtaccctgatatatttttaaaatggtgaaggtaggcgaattgattgtttttttaacaccaagccccttaccgagatattttgtaaatgttgtcttaccggctcccagatcaccgcttaatgtaatcagcattcccggttttataagagaagctaatttcaatccaagttctccggtttcctccagcgaacagacaggtatttgtttcatcgttctcacctcttatttcttctgcagtgctttcttcctctgcttcattgcccattgcgatagagcatacagtgatttgtaaacaggtaaatcaaactctccgataaattcattaatcgttgggttataattcgccttgaatttggtaagaccgcctttcaagctgccttcgattcctcccatattactccagcgacagcccttttcaaagctccatgtcatacagctgtaaaagctggcataaggtgccatataacgcttatagcgctcatccattcctgcatacagtatttctgcagtcggtccgaattttacacatagcgccccggaaacaaccgcaatatcaccatcacgctccagattctcctgcagctcctttacctcgcgactaagagaggcgtgaagctcttccagtgtaaagcgttttttcttcgcattctccggacattttgccaaatctctttcattctgctcatatcgctgctttgtatcctcatacagcttgcgaagcggcagcttggccagaaagatgacggcatcctcaccgtagatttccataagacgctgaaaatattcctgatcccgcagatgaatatttttacgctcctccgtacaatgcataacccttgcaaaatcctctacaccatccatatgataaggcaaaacctcaatcattttcttctgaaccgtctgtaatgctttcctacagcctttggacaaggtagcattaaagtcatcacaggcgtaaacattggcatgataacgcggctgaatggtatcatcaatatgctttgtgaatcccttaaatacagccccctgatcctgcagcatctgtatcatagcatcgatatgctcataatggttctcatttgcttcttttattgtataatcgttacagtggacagctggatcaaaggtaataaacaggcacctgtacttccttgcatagcgcttcagctctttcatgagaaatgccacaagcgcagtattcgaaaaatccagaaccggtccacgtggaatataaaacatactgaatcccagtggcagtggcttgatgagaatcatgcagcttgctaccagctgattttgatattttacacccacaattgtgtgcttccagttttcctttacaagaccccagctgctggattgcagaagattgcataatttatgtttgcttacaaacgcatcatgctcctttgcatcgacttgttctataaattgatattgcatactacctccatagaactatttgttctttaatttcttataaagtgcatacggccccttttggattggcagaataaaatcaccaaccagctcttccacgacaccgtgaaagccttttttaaactcataaaccccataatcctgcgcattcttatcaaaatcgccggataagccatagaaattatatttgcgaattccatgcttcagagcatactgcagcatatgccactgaattgcatacggcgcattatatttcttaaaggtatcatatgcggcgctgtaaaggtagacaagctcatcttgcgactgaataaaaaacgacgtagccatcggtatacaggctccatgctcctgctccaaggtatccgcatccttatatttcttttcattcaatgccaatgcttcatccaatacctttttcttcttgataaatttcttactattcggcagttcttcaagcttggcgagtatctctgcatgctctttttccagatcctgcttttccaaatccagctttctacggaaatcatttaaatcgagatatgccaggagtagcttcgcatcctcaccataagcaatcatttgatttcggtagaattccggctcacgctccgcaaattcacagcgctgtgaggtatgatgcatcatatcaagaaagatgtccagttcatcgatagacaattcacgcacctgtattccctgctttaaggttttattcactgaccagcgtgtctgttgatgcatttccttgaggagcgtattctcatccttgccatccaggtataaggcaaacatccagcgaatctctgaaatcacctgaaaatccttggtaaagccctgatgctcatatcctgaagcaatcatattgtccactacataggaatgatcaaagccattttccaccagctcaccatcgatatcgcgctctttatataatacatttgggtcaacaactaaatataagcccttttttttcttcaaatatgcggctagctccttcgtaaaaaaacgcaaaagctccacgttatgataatccattagaaatccgcgttgcgcatagtaaaaccggtacagcttcattaccggtatggatgttaatggagttgcacagataactttatcctgctcctttactccaacgtactcaacatcccaatgattgattttttttaaatccatcgccttcagcgagttcataaaatcccgatagggatgctgattccggaatgcttcatattcctgaggtgtcaacgttgtaaactccaaaatttcgtcctccttttcaaatctatcgtaatctgtaagcataatctgtatgcattttcctcatatcgtcaaaacagtattattataccacgtttgttgatgattttttaaattaagggtgaaatttaagagaacttttctgttttatagataaagcacatatattcgcctgtgaaagtaataaaatggattcgtagagcatgctttctattttcacaaccagaaataaccagctgtcttattcttactatacacttatactaaacacatatagagtcacacctcaactacttataagtctgagattttgcagggtgttaatgaaggatacagattcataaaatcagatttactatatgtattattatgaatctatgcaaaaaaagacccatcgtaagatgagtcagattacctggcagcgtgctatcttcactggagccagtccagatattgtcgccgctgatatgcttaacttctgtgttcgggatgagaacaggtgtgtccacatcgctatcgccaccagatcactttgaggtctctccctcaaaactgaataacagttgacagtttcttcttttgtaccacctggtacgtgtgattaagtcctcgacctattagtatcagtcaactccatgtatcgctacacttccatctctgacctatccacctcgtcgtcttcaaggggtcttacttcgttatacgaatgggagatctcatcttggagtaggcttcgcgcttagatgctttcagcgcttatcccttccctacttagctacccagctatgctcctggcggaacaactggtgcaccagcggtaggtccatcccggtcctctcgtactaaggacagctctcctcagatctccaacgcccacaacagatagggaccgaactgtctcacgacgttctgaacccagctcgcgtaccgctttaatgggcggacagcccaacccttggaaccgaattcagctccaggatgcgatgagccgacatcgaggtgccaaacctcgccgtcgatgtgaactcttgggcgagatcagcctgttatccccagggtagcttttatccgttgagcgacggcccttccattcggcaccgccggatcactaatcccgactttcgtccctgttcgacttgtttgtctcacagtcaagcacgcttctgcatttgcactcgtcgattgatttccatccaatctgagcgtacctttgggcgcctccgttactctttaggaggcgaccgccccagtcaaactgcccacctgacacggtccctcacccagttcatgggtgcaggttagaacttcaatcaaacaagagtggtatcccaacagcggctctgactacactggcgtgcaatcttcttcgcctcccacctatcctgtacatctttgaccaaaattcaatatcaggctacagtaaagctccatggggtctttccgtctagttgcgggtaacctgcattttcacaggtactaagatttcaccgagtctgctgccgagacagcgcccaaatcgttacgcctttcgtgcgggtcagaacttacctgacaaggaatttcgctaccttaggaccgttatagttacggccgccgttcactggggcttcaattcattgcttctccttgcggatgacaaatcctcttaaccttccagcaccgggcaggcgtcaccccctatacttcgtcttacgactttgcagagagctgtgttttagttaaacagtcgcttgggcctcttcactgcggctctcttttacaagagcactccttatcgctaacttacggagtcattttgccgagttccttggcaacagttctctcgctcacctcaggattctctccttgcccacctgtgtcggttttggtacgggccgctatggaattatcactagaaacttttcttggaagctggcatcatgtgcttcagtacttgtccgaggacgttcccttacctgtcacatcttacatcccgctgacgcatttcactgtcagcctgctatatgcttcgaccacaatccgttcagtggctcacactagccttctccgtcattccttcatttccatcgcgggtacaggaatatctgcctgttttccatccactacgcctttcggcctcgcgttaggtcccgacttacccagggcggacgaaccttcccctggaatccttgggctatcggtgtgtaggattctcacctacatctcgctactcacaccggcattctctcttccatgctctccaccgctccttacggtacggcttctacgtgcatgcaacgctcccctaccactcaactctgaagttgaatccgcagcttcggtagtatgcttagccccggtacattttcggcgcagggtcactcgactagtgagctgttacgcactctttgaaggatggctgcttctgagccaacctcctagttgtctgtgcatccccacatccttttccacttagcatacattttgggaccttaactgacggtctgggctgtttcccttttgaccgtggaccttatcacccacagtctgactgccgagtatgtctgcatggcattcggagtttgattatactcagtaccccgggatggggccatcgtacattcagtgctctacctccatgcgactctacctcgacgctagccctaaagctatttcggggagaaccagctatatccgtgttcgattggaatttctcccctagccacaactcatccgccaacttttcaacgggggtcggttcggtcctccattcagtttcacctgaacttcaacctggtcatggctagatcacacggtttcgggtctacatcatcgtactgtcgccctattaagactcgctttcgcttcggctccgtatcttctacttaacctcgcacgataacgtaactcgccggttcattctacaaaaggcacgccatcaccctttaacgggctctgacttcttgtaagcatacggtttcaggttctatttcactccgctcccgcggttcttttcacctttccctcacggtactggttcactatcggtcacttgggtatatttagccttgacggatggtcccgcctgcttccgacaagatttctcgtgtctcgccgtactcaggataccactaggcttcacattgctttcagttacgggacttgcaccctctccggtcggcctttcaatgccgttctcttagccatgctcttgccatttcgtggtcctacaaccccagatcaagatctggtttgggctcctccgcgttcgctcgccgctacttacggaatcattcttattttcttttcctccggatacttagatgtttcagttctccgggtacctccctcatgagctatgtattcactcatgggtgacagctcattactgctgccgggtttccccattcggatatcgacggatctttgtgtacgtaccactccccgtcgcgtttcgccgtttgttgcgtccttcttcagttccaagtgcctaggcatccaccgtacgcccttattcacttaatcacgattaagttttaagcgttcatttctttgcttgagttttctgtttttgtttaactttctactcgtgaatatctatgctgtttacaactttcgttatagaccttcatatgtcttctgttattcagttttcaaagatcgacttctttttcgtttggaagatcagtcttccaaaactgaacaggaaatgttcgataactctttacttattcttgtactttctccttagaaaggaggtgatccatccccacgttcccgtagggataccttgttacgacttaaccccagtcatcggtcctaccttcgacggctcactccttacggttatgccaccggcttcgggtattactgactcccatggtttgacgggcggtgtgtacaaggcccgagaacgtattcaccgcagcatgctgatctgcgattactagcgattccgacttcatgaagtcgagttgcagacttcaatccgaactgagacgacctttatgagattcgcttcacatcactgtgtcgctgctctttgtggccgccattgtagtacgtgtgtagcccaggccataaggggcatgatgatttgacgtcatccccaccttcctccggtttgtcaccggcagtctcgcatgagtccccaacttgatgctggtaacatgcgacaagggttgcgctcgttgcgggacttaacccaacatctcacgacacgagctgacgacaaccatgcaccacctgtgtgatccataattatccccctatctctagggtatttgtttccatgtcaaggcctggtaaggttcttcgcgttgcttcgaattaaaccacatactccaccgcttgtgcgggcccccgtcaattcctttgagtttcacacttgcgtgcatactccccaggcggagaacttattgcgttaactgcagcactgaattcctccaacacttagttctcatcgtttacggcgtggactactagggtatctaatcctatttgctccccacgctttcgtgcctcagtgtcagttacagaccaggcgaccgccttcgccactggtgttcctccatatatctacgcattttaccgctacacatggaattccatcgccctcttctgcactccagcataccagtttccatagcttacaatggttgagccattgccttttactacagacttagtacgccacctacgcaccctttacgcccaatgattccggataacgcttgccacctacgtattaccgcggctgctggcacgtagttagccgtggctttctggtaagctaccgtcactcccatagcatttcctctatgagccgttcttcacttacaacagagctttacgatccgaagaccttcttcactcacgcggcattgctcgttcagggtttcccccattgacgaaaattccctactgctgcctcccgtaggagtttgggccgtgtctcagtcccaatgtggccgtttaccctctcaggccggctacgcatcatcgccttggtgggccgttacctcaccaactagctaatgcgccgcaggtccatccatgttcacgccttgatgggcgctttaatatactgagcatgcgctctgtatacctatccggttttagctaccgtttccagcagttatcccggacacatgggcaggttacctacgtgttactcacccgttcgccactaagtctctttggaagcaagcttcctcgaaacttcgttcgacttgcatgtattaggcatgccgccagcgttcatcctgagccaggatcaaactctccatttgatttagctctaacgcatgacttgcgtttgaatttcatttttgttatcgttataccgagaatattgttttctcaaataattgacgtttcctgttcagttttcaaagaccgaaatttctatttcgcgcgcccttgtttctcatcagcgctcgtatataatacaacacatatccctgtgtgtcaacagctttttttatttttttgacttttttgttatatttctttcatataccgcatagaagccttatttcattcttttatcctcatccatatagcgcaggtatttatcatacaatgccgatatttcccgatgctcaaatggtgaattttgcagacggatatccaccatcagacgatccaatccgtggtggattgctttatccagcttttgactgtagcccatttccgcagaatgctcctgatattcatcctcatccagcagcgtagttttccctgttggtgaaaccttgacatccagatcataatcaatattctttattgcttctccgtcatacagtgatggagatgccagattgcagtaataatgaatacccgattttcgaatcatgcagatgacattgtaccatttatccggataaaagaagcagattgccggttctctggtcacccacttgcgtccgtccgattcactgacaagtgttttattggttactgcaacaatacgccgttcattcgcttcgataacataaccctttgcccaggttctgtgaagactcccatcatgcttatagctctggatatatacatattctctttcttgtatttccatgacgtcctcctgtgagtatctattatagcagataaaaccttgaaagcaaatgcatacaagtgtaattttcctaccatactattgtatgaaaggagatgtatgactgatacatagagtcatacgagtgaacactatgctgacaccaaaagacgtattgtatatggaagatattctggatcagacgcttgttttgaataagcgtgtagccaatgatatctcaatgattcaaagtgaagatgttaaaacctgttttgagaacgtacaggaaaaattgaaggagcactaccagacattactggctatcctggaaagtgaggcaaaataacatggctgataaatcaaagagctatggcgataaggatatcgctaccaacctgcttgttacattaaagcatatgaaggcggaattaaatacctttacacaggaagcaagcaatgatgagctgtttacaaaaatcgatgaggtttatacctgtgtatccactctgcaaagagatgtcttcaatatgatgacagctcagggctggtataaaatgactgctgaatcagcaaaaaacatttccaaggcttatacgaagttttctaaaagtgaaagtgagttatcctaataggaatgattcacgcaatcacgcgtcattgataaagctgtaaatataggaagaaataatttcttacatggaaatttatttcttctttttatttatgcctgttacttgaagcgctatgagtttccatagataactgctttttctttttatactttcatgatacgatatcttatatattaagagaggtcgaattatgaaagagaaaaagtatgaattgattctgcagcagctgcaagccttgctggagggagagcatgatatgattgcaaacatggcaaatatggcagccttattattccatgagcttccggatttgaattgggcgggattttatcttatgaaaaataacgagcttgttctcggtccgtttcaaggcaaggcagcctgtatgcatatcccgtcaggcaaaggggtttgcggaacctgcgcgctgcaacgctgtacacagctggtagaaaatgtacacaccttccccagccatattgcctgtgacagtgcaagcaactcagaaatcgtggtaccattgataaaagaaaacaccctgctgggtgttttggatgtagattcacctatcctagccagattcgataccatagatcagcattatctggagcaggctgtagcaatattgcttcagtctctgtgaatatggaaataggccgtggctagcgtaatagcttctctggcagagaacatgcggcagcgtccgttcccaatgtaagaggttttcacaacgcttcgttcttccattgcttctccgatttcggagaagctttttgtatgataatccagatcaagcatatccttccatatggtctgtttattattttctataggagcacttaccagacggatgggaagctgatctcccgaatagcgggcaagatgaaacatgctacagctttcatattcacagccgagcagtatggtatatccattgaattccacaattttaccaagtggagaatccttactgagtccaaaatgcaaagggtgacgatcgcaaatcagcttcgcatatttgccccatgccgcaaagctgtacaatggatgataggaacgcacaactccttcattgcgaagaaactgtagtgaaagcgcatcctggggcgcactcagttttcgatcaaacggaaaagaagacgcacgcacatcatcccagtaaacacgttccaccgtttttttctggcaggatggatcaagcagctgaggagtaaaggttggcatgaccagtgtaccctcatagccgacggcatcgatcagagcttctatcagcgcctgctcaccgccaattaaatagcccagtctctgcaggtctgcctgaaccagaagtaccattcccttctgtatccccagtgacatgagctgctgtacgatttcctcttttgaagaaaccgttgcagtatcctgatttaatgtagtaaatgcagatcgttcagccattttaacaagtccttcttttccagataaccttctttgctattttcaggcagcagacttccctgataaaagtaaaaggttgacggcaggctttgaatttttcctgtcgttatttgcagttcttcaacagcctgcttgatgtccgtatcttcttcgttggtatccatcttgagataatagatttcaaacggtgtttcttcttctatctcctgtatcactttttcatactcatcacaggaatagcagttatccgaggtgatatacagcatgaaggaattctttttcggatcctgcagtctgactaaaacttcctgaggagtcagttcaatcggttctccctcatgatctttaccgcatccctgcaagaaaaacatcatgcaaaacagacagagcagtactttcttcatgaacagctacacctcgctttctggttttattttaccacagaatatgcattctctgctatttttttcagtaatccacagaaaaagtcaccctgcgatcgtttttggtggggaaatgaatacgcagaatgactatctgaagtatagcatacaatgatggatgaaaataatcatttgctcaagctgctatttattcagcagcttttggtctgcatcactgccctgaccatatgtgaggtttcatacgaattcatccccctataagtggtttatcaaatatatatggtcattcttcatcgttttcatgaaaagccctactgaaatccatgcagtggaaatccctagatcacctctggaattccacagaagactggttcaacacaaagctaagcacttttttcgtgatttctttcgtcctttttactttcaggcattaaaaaagcctttatttaaaggcttaacttactttatggtgccggtacccagaattgaactgagcgctgagcattaccattgctctgtattaccactatactataccggcaggtatgctttatgattggaaagctattatattataataggcattgccgattttttcaaccataaaacaaaattttttagtttttttccagatacgctttcaggtgtcggtaaactgcagcaatcggcagccccataacattgaaataatctccacgaagttctcgcacaaacagcttccccattccctgaatcccataggctccagctttatcatatggctcattgctgtcaagatatcgctcaagcagttcttcctcaagctcatagaaggtcacgcttgttttttcatgaaaaagctcagcttttcctttccaaacaatagccacaccgctgacaaccgtatgagttttaccgcttagctgcttcaacatacgataggcatcctcccgattctccggcttgcccatcatctgatctttgtagcacaccatcgtatccgcaccaagaacaacagcctcggggtgctgttcccatacggtaagtgccttctgtctggctatctgttcgattgcagaagcaatcggcagggaacggttaaaatattcctcacaatccgcagcaacaatatcaaagggatacgataggtcttgtaacagctcctgtctcctgggagaagcgcttgcaagaatcagacgtctagtcatgatgcagttctccatgaagcttatgaagctgatgtctcaggaaaagatagcagaatacaaacagcccgatgaatccggtcgcaaacatacccacgatacgaaataccatcgaggaaaagaattgtgctggaaacaaattgatcatcaggtcggttgccggattcagcagccacagatcattgcggaatgccagcttgtggaaggtagtccaaaatgcatcaaaatcaacatacgcccagcctgccagcattgcgaaaaacaccgctgccagtatcgccgttttcatataattgatactaaaaatcgtcagcattccacttttcaagcgtaccgccatgtacaccagagaaagcacaagcagaatgatcgcaacatttctcaacaccatggcaaaccggtacaggttgcgtacatcgaccatatgggaggattctctcgcattgaatgccttggtctccgtccccttaaccgctacggtgacatcaatattatcccggcggtcctgcagataatccagcagtgcatccgttgccttgttgagatccttctccgtcatccctaaagactgtgcagtttccagtgatgcatattccgttttataaaaacccttattgaagcaatttatgtttatactcgtaaccagtagaatcacgattgtgcagacagcagcagtgtatgccgccaatgtcgttagtttttctaacagctgtttcataggatactccttatatattaaatggctttttatatcgtaccatatttcagaaaaaaagaaaatcacctttttttaaaatcagacatttacaaagcaaagcacgctgctgtacacggagcaatttcccatatagaaaggaaaccatggaggatacacctgcaagtacgagtctactgtcacaggatggctttgtttttccccttatcccagctagtacatacaatatagattgagaaaataaccacagctcctgattcggaacatctatcaccatgcaataaaaagcgtcagcatggaaaaagcgggattccccgctttctaatcatcctgtgcaatgattcttatccgcacattccggtcacgttattctacagcaatcagacgcagattgcttacaccgcggcagctgcgcagacgctccagtagctcatcgatggataccgccatttcgcataaatcaaaggacagtaccaccgacgcccactcatgaatcggaatattctgattgatggtcaatatattggcattgacgctcgacatcgtgttcagtacctctgacaaaatccctttgtcatgatgcagcataagagatatcacagcctttcgctcactcattccctgagctggcagaaaaacatagtccttatatttataatatgttccgcggctgattccgacacgcttgacagcctcgctcacctgctttacctcaccgttttgcagcagggagcgcgcttcaatgaccttgtccagcacatccggcagaatcgtactgtctacaatatagtatttctccatcagcatacctcgctttgcacaccgtcataggtcgcacgcagaatacgagcatcccaggatggatactgattctttattttttcaacaagcacacgggctgccgcttcctcctgggtcagagcgatcatcgtcgatccgcttccggatatatacatggtaatcatatccgtttccctgcacagactgcggacattctcatattccataatcaatttcttgcggtagggctcctgcatctgatctgtgcaggcttttctcataatcatggcattcccgatttccatcgcctttgccaatgccgcacagtgccccatctgatagacagcgtcccgatacctcatggtatccggtaaaacctcccgtgccgctttggtgcttacctcataatcgggaatcattgtcacaaacagcaaatcgcgttttacaccgtaacgaatcatattcggcttcccgtcttccatgaaggaaacgcacagaccgccaaagatggccggagcaatattatccggatgtccctccatctgtgtcgccagatcaaagagctcatagcggttcatgcggttatgaaacagggcattcgctccagcaagtcctgcgacgatacaggttgcgctgctgccaagtcctctggcatagggaatatcggtatccacggtgatgcggattcccgaaacgctttcccccatatactggagcccctttacaaatgcctgataaaacagattctcttcattgcagtaggcttcttcacagcccgcaatttccaagccctctgcaatcacctcaaaggtcacggtcgcaaaatcgtcaagcgccaggccaagacagtcatagccgactcccagattcgcacttgttgccggaacacgtaccttaaccatggaatatttcctccccgatggtttccacaaaggaaggcatatcatccttatcaatcaggtggctgtgcaaaatgtccattttcgcaagctctgccagcggcttcggcatcgcagaaccgcttttctgctgcagcatttccatacaggcaaactcatcctggattgtttcattaaacaaagcctcgtaaacagccggtgcaaatttgtatggactggctgtggaaagcaacacacatttatgcatggaatcctctttttcataatccttcatcaccttgtaggcgattgccgtatgcggatccataacataaccgctctgttcataaaattcacgcatactctgtgcacatgccgcatcatcacaatagccgcccgcaaaatcttcacggacagaggtgaaaatgtcctcacgcacctgatagcgtcctgttgcttccagctcgttcattagctgtgcgatatagtcagcatccttgccgctcttgtagtaaagcagccgctccaggttgctggaaatcagtatatccatactcggagagatggttttatagaacggacggtttcgatcgtagacaccgtcctttaaaaagtcaaagagtacattattggaattggatgccacgataaatttgtttaccggcaagcccatcagcttggcatagtaaccggcaagcacattcccatagtttcctgtcggcacacagaaattcactttttccccaaatgtgatttcctttgtccgtaccatttccttatatgcatacacataatatacaacctgcggaatcagtctaccgatattgatggagttcgcgctggataaggtgatacccttttccttcagccgtgcagacagctgtgcattctgaaagatccgcttcacattggactgggcatcatcgaagttacccctgatggcacagacacaggtattgcttcctttggtggttatcatctgcagacgctgaatattggatacaccctcatccggatagaagaccgtgattccggtacgcggcacatccaaaaagccctcaagggcagccttaccggtgtcaccgctggttgcggttaaaatcatgacatgttcatcgggatgctgctgcagggatttgctcatcagctgcggaagcatgcgtagccccacatccttaaaggcgcaggtaggaccatgaaacagctccagaatattggtgttccccgccttatgaagcggcgtgatgtgttcatctctgaatttgcccttataggcattttccacacagtcctttacttcttcctcggtaaaatccggtaacagcagctgcagaacagtttccgccatctgctcataggtcatctgcatcatatcctgcagcggcagacgcagcgtatccagcgcatcatagacaaacagaccgccatcctctgcaattccctttacgaccgcttccttgggtgtgcgcgccagcgctttgtttctcgtacttgtatatattttctccatgttccaatctccttctttttcgtcttgcaattctttttttactatgatacaatgttcgcaataaaaaaacaagtgtttttgaaacaaagacacaaaaatttattgaggaggaattatatgaatatagcaatactcggttatggaaccgttggctcgggagtaaaggaaattattgatcacgcggtaacaaaaagcaccaaacagttgcacgtatcctatatactgattcgtaagggaaaagcgaaaacacttccttacatgtgtgatgatatccagacgattttacaggatacttctgtggatgtcatcgtggaaacgatgggtggtcttgagcctgcccacacgtatattctgcaggcattgaaaagcggcaagcatgtcgttacagccaacaaagcggtaatcgcagcttatttgaaggagttcacagatgtcgcaagagagcacaatgtccgcatttactatgaagcaagcaccggaggtggaattccctggattgaaggactggcaaaggcgatgcgaatcgatgaggttgaccgcattcacggtattttcaatggtaccagcaattatattctggatcacatgcagcgctaccatgcatcctttgaggatattctgaaggaagcgcaggagctgggctatgcggaggcagacccaagcgctgatatcgacggctatgatatctgcaacaagctgcgtatttctgccagccttgcttatgactaccatgttccggataccttcccggttttcggcatccgcaatatcacgaagcaggacgtatcgtatttttcatctttgggctatgctgtacgtctgattgccaaaacccggcgcaacgccaaccgttatggctgtgttgttgagccggtgttgtttgaagccggttctctggaaagcaacacacaggacaattacaatctgattaccctgcatgggaaaaccattggagatttaaagtttttcggtcagggtgccggaaagcttccgactgccaacgccattgtacaggatctgattgacctcaatgaaggcgtttgtcacatggatccttccttcaccaatacgatgagctatgatgagacactgtgtctgcgtgattatatcctgcgtgcagatgaggcggcacgtgatgagctgcaggatttcagctatgaggtgaaaacctttgaagggcaggagtatctgcatattcagaaggctgaggtatatgaaatgcatcaggtgatggaacggatgctgaagacagatgtccatgcctttatggccagcatctatgaaagggaggatgactagcagtatgatgaaaataacaaagtttggcggttcgtcggttgcgaatgcacagcagttccgcaaggtgaagcatatcattgaaagcgatccggcccggcgctttgtcgttgtcagtgcatccggacgtgagcataagaaggataataaggtgaccgatctgctgtatctgattgaggcccatttaaaatacagcgtcgatcatttatccctgtttcatctgatagaggagcgctttatttccattaagaatgatcttgggctgagctatccgattgaggaggacctcgcaaagctgaaaggacagctgaataagacaatgtccacggattatctggtttcacgaggagaatatctgaccgctaagctgatggcggagtatcttggctttccatttgtggatgcaaaggatatcatcaccttccgttatgatgggaaaattgattttgatgcgacaaagtaccgaatggataatacaatgaagaagctggaccgttttgtcattcccggcttctatggcgcactgccggatggcaccgtgcgtacaatgtcacgtggtggaagtgatataacgggttcaattctggcggatattctaaatgcggatatgtatgagaactggacagatgtttccggcatactgatggctgacccgagaattgtccaccatccaaaacgcatcaacaccatcacctactccgagctgcgtgagctttcctatatgggggcaagtgttctgcatgaggaggcgatttttccggtaaaggaaaaaaacatcccgatcaacatcctgaataccaatcatccggaggagggtggtaccatcatcgtggagaaagatgatcatccaagcgagcagatgattaccggtatcgcagggaagaagaatttcaccgttattgccatttataaaaaccacatgtcggatgaagtcggcattatccgccgcgcgctggaaatctgtgagaattaccggatcagcatcgagcatattccaagcgggatcgattccttcagcatcgttgtcaattccgaggatgtgaaggatatcatttacgatatggtgggcgatatgaagaaagcctgcaatgccgatgaaatcaaaatcatcgataatatttccctgattgccacggttggccgtcagatgatgtatcgtccgggtatcagcgggaagctgtttgctgtgctgggaaagaataatatcaatattcgcatgattgcgcaggggacggatgaaatgaatatcatcgtcggtgtggaaaacaaggattatgagaagacagtggaaaccatctacaacaattttgtcgtttagacacaccgcatgcttcacaattcgcgcatacagaacatatagatagaatatgaggagagagtgaaatgaaaacatacaaggtcgcaatactcggtgccaccggtgctgtaggtcaggaaatgataaagattttaatggagcgcagcttcccaatccgtgagctgcatcttttggcaagtgcaagaagtgcagggaagaagcttaccattgccgataaggagtatatcgttgaggaaacgacagaaaacagcttcgatggcatggatatcgttttaggagctgcagaaaatgatattgccgaaaaatatcttccgattgccgcagaaaaaggagcggtagttgtggataacagctcagctttccgtctggatgagcaggtaccgctgattattccggaggtgaatccgcaggcagtacgtgagcatcacggcatcattgccaatccaaactgtgcaacgattatcgcactggttgcgctgcagccgctgcatgcatatgcaaatgcaaagcgtatggtcgtttccacatatcaggctgtcagcggtgcaggcgtcaatggaatacgtgagctgaatcagcaggtgggtgcgctggcacatggcaaggaggtagcagtcaataccttccagtatcagattgcctataatctcattccacagattggcggcttcaacgaggccggatattctagcgaggaaatgaaaatgcagaacgaaggacgcaagattatgagtaatcctgagctttgtgtaaactgtacctgtgtgcgtgttccggtgattcgttcccattccgaatctatcatggtggagtttgagaaggaaatcagcgtggaaaaggcaagggagctgctgcagggggcaccgggtgtcaaactggtggatgagccgcagaagcaggtatatccgatgccgctggataccactgatcaggatctggtgtttgtgggtcgtattcgtgaggatatgagcggacatgcgaatgcattaagcttctggtgctgtggagatcaggttcgcaagggggccgctaccaatgcggttcagattgctgagcttgtcattcaggaaaaggaaaaacagcaggaataaaggaaaactgttcctactgatatgtaaagctgcaataaaaatctcaaattccgttcactgtgacagaatttgagatttttttgttcggtatctccctgtacttgttcttataggaaggcttccttccattcgcattttcgtatttaccatgcggtaaatatacgaagcgggatacatacagtatccattgctctatacgtgcaatacaatcgccatcaacctgcgggtttatccgttgccgcatacaggatgttctctatacagcggtatgtgtcctcgcattgttccagcatcggcatgtgacaggcatttcttataaaatgaaactgcagccgatttactgtttcccaatgtagattcaaatcctgaatccgatcggcatactcacagattccgcgatctccatagatcatatgtatcggtacggtaatatccgtcagcggactgtaatcaaactgctactgcagctgcttcgccagtgtatcctgataccatacggcttcctttgccatctccttttgcagcttagcacccagtgttgtcatactctgcttcataacgagattacgataaaagggctctgccggacataaattgctctctatgcaaataacgcatttcaccggcacaccaacatcatgtaccagctgcagggcaaggattccgcccatgctgtgtccgattataacatcaatatccctgggaagctgtgacgcaatccaggaagccaaatccatcacctgaactgcctgtgacgtaacctcatgcggatactccataaatagcaaatcatgttctttcaggcaggaagctgcctgtttccaaagcttggatgtacaatacaagccctgtagcatcaatattctcatgttcctttttctcctatagacgaatggagaaattttcgtatcgaaattccccgctgccatgctgaagcagacctttttcctgcagctcctcccatgcctgtgctgtctcctgaatcagtgaaggccccacttcgattgtataatgggcaggcagcaggcgctgaagcgctagcgtttgcagcctttgtaccgacagcaggtatgcctgtggatcagtggacggataatcacagtacagaacacctttatagataagatccccacagtacagccattcccgttccaaatcaaaaaaacacatatgtccaggagaatgccctggtgtatgcaggacacgaatatgacgaccgccaagattcaggatatccccatctcctacaatgcctgcatgcccctgccatacagtataggcgttcatatgaaaatcccctggaaaagaacagggctctttcatcagctgctgcttcaccataccaagcggcagtggaaattttccattcagccaggaatactcccgttcatgaaccagtacatcagtatagctgccatggctgccgatatggtcccaatgcacatgggtagcaattacagttaccggtaatgcagtcagctgatctgttattttgcggatatccgcgactcccagaccactgtcaatcagcaaagccctctgctttccgagcagcagataacaattagttttttcataatgcttatgctctgaaatcacataggttgtatcatccagcatttcaacctgaaaccagtccttcatatatacacctccgcttcccattcagtataacacttacagcatcagccgtaaagcaaggatcctttcacctttctgtttccagcttgaaataaatttcgcatgtaactgtaaacagcaatatacaaaaggaatccatcagctgacagaatattttctacattatgatgtgagtcacctcagaaagtagaatagaatagtaaaaaaacctgtatccagaaaaccgatatagtttcggcatccgttttacaggctacagctttgcttgatatcaggcattcttcatttcgtttgctacgggctctgaaacaaactcttctgcttcctcttccacctcttcttcgattacatcctcaatacacagacgaagtgtacttgtcagatcattgattttcttcagaacctcaccgattccataggccaaaaaagcgaagccaaagtaaggtacacagccggtgaaatacaaattgagaatatctgtcagctgcagtgtatatgttgttttatagctttccaccgtcagatacgcctgatagatttcaaaagcggcaattgccaggaagataacagaggccacataaaagacgatacttgccttggagattttcatttcttttttcgttttcatgatttcaacctttctttacgtgtccctattatctactataaatgtgtgaataatatgtgtactatgtgaatttttgaagaatttttcaggtaagcgttcccacctatcatcaacggattcactctatggtatccctgattgtatcgtatttcctcagtgaaccataccgttactgatacaattctcttatttttttcaaaaacatctggattattcatgaaaaatatagtatgataaataggcatttaggaaacgcagacgtggtggaatggcagacacgctactttgagggggtagtgagcgtatgctcgtgtgagttcaaatctcatcgtctgcaccattttgataaataagccggtaaatatcggcttttttatatggttcacagtatgcagatcattatattcgctctgtttgagactgctgctgccttttatatgaataaaaatcaggcatcgatctcagcatcccagatcaacagcctgattttcaaacgcattcgggtatcttccccgtttcttattttattatattttctgaactcaagactaagctagcgtcatatgtttatactttctcagccatgagcagcatggataacggcaagcccattgcatcatatacatccgacagtccgatatcataatcatattcattcagcagccttacactcataccgctttgtatggtgctgttcacaagctctgaaatggagtgtgaaaagcttgtgaatgtcttggatgcataatctccggaaatataccccatcccattgttttcaatccatggctcagctgtgaaatatttatgctccagcagcctgacgacatcatcgcaatagcagtcctcccccggcagaggaagcatattcataagtggatgaaaatcatgaatcagcataatgcccttcggctttagacagtcggacaccacccgaaaaagtgcgtttacatcctgaaaccaggtaattgcaccgatcgtaaacaggatcacatcgaatttctgatgatattcgcttcctatatccagaatattcatagcggaaaagctacatggcacatgcagctgctttgcatgcattttcccctgtgcaatcagattttctgcaatatcaaagccggtaccgactgccccatagtgtctgctgatggacagcagctccctgccgttgctgcagcaaaactgcgcaacatgttttccagcaagattcagttgatcaagctcagcctgtaacgcgggctgaatgtaataagcggatgatgcctggaggttttcaacgactgcatctccccagccattgattctattgtcgaacgcttcctcccacgcttccttgttcttttctatatagctcatgttttctctgtactctctttcctatcattatattcattttatttagcctcctttcccagtatgcaagcataactgattccttaaattatatcataaatctggagcatacagcctggttttcataattagagctatagctgcaaactcaccataccttctataattttatgcgtgtgatataattttctgaaatttctgcatggaactggtgttttgccaatactgcagccctttctgaacataggataaagtagaaaacagagaaatctgttttctgaagctgcagtgataatttcattccatgttcattcctcatcctgaatgatcgttttaccaaatcgtctcctccccttatcatcggatcaattacgattcgggatttcatcattgattctactctttccctttccagaagaaaaagaatcctaaacaagaaaaattcctactcccttatggggtaatccaaaattaggagaattcaacacgaatgtatttatcaatagcatttgcatcctcctacttgcaaacaccctggagtaagaaagaacaaaggcaaagcagccactgtgaataagtgactgctttttcaattatagacttttgcgacgaaatataataactgccgctgccagctgaagcaggatagcagtaactgcacagactgcaggcttcagaaattcctgcatcgtgatgccatcggtaagattagactggtactgtgacaaaaacacaaagggtgaataatctgccaccgcagcaaacatcgttatcagcacacagagcagaaacaggcagccggcacacagcagacttccggaaacagtccccttatacacgccccccagaatcatagaggctgtcatcatcaaaccaaacagccataccccagttacaagcggaaacagatgcgacacgagagagctttcccagaatacgaaattgtacagaaaggtaatcaggaatgagcatcccagagacaatgtccacaagcatgatatggaaataaattttgcggcaagaacgctgttgcggggcatcccttttgccagcagcggtatcagaaccccctttccgatttcattcgccattgaggatgagcacataataatgattgctatcaagccgatctgcgccgtatttttgaagaactggagccaggaatcaagtacgacaggctgtggaatctccatatgcataccctccggcagaaaacctgcgaccagctccggtaaataacgtgcactgactggattcataaatcccagtgctgcaaatacaatcaataatatgacaagcttataggaacgtactgcctccagcagctcctttttcataaacgctgtgaatcccttcattttgtcacctccagaaaatactgttccagagtcggacgcatgcgctccagcctctgcagccgcagcccctgcgcatttacaatagctaaaacctgctgctgtgtttccatatgatccggcaactgcactgcatacggatgtgtctgttgtacggcaatgccccgctttcgcaatgcttccagcaacagcgagcactcctcctcacacttagtttccacataaagcgatgcagttcccttcatctgcagcagctcatgtaaatttccgcttacggcgatctttccctcatgcagaatggcgatggaatcacaaatgctttccacatcactcaggatatgtgtggaaaacaataccgtcgttttctcttttgccttttccagtattgtcagaatctccttgcgaccctgcggatccagcgccgatgtcggctcatctgcgatcagcagcttaggctcattcagcagcccctgcgcaatcgcaaggcgctgcttcatccctctggaaaacgtggcacatcgtttttttccggtctctgataatcccaccagctgtaaaagctcatcaatccgtgtctttaccttctgcgcagcaaggccggatatctcagcacacagctgcaaatactcccatgctgtcataaagccgtaaaattcagggacatcactgacgtagccgatataacggttcgttctggtatttccaaaaacaaccggctcctgcataatatacaattccccggcatccgccttttccagaccgagaatcgttttcattgtcgttgtttttcccgcaccgttttttcctataaacccgaagatactgtgctgcggtaccgttaaatcgatgccctgcaaaaccttctgccttccgaaggctttatgcaggttgcgtagtgttaatacatccattgctactgctcctctctgccgattacaaaatagagaatcggccccagaaactgaagaaacaaaataaccggtatccagatccatttgtttccaatcctaacctgtggatgacgaatcagatgaatcaatgcaaatattgccagaccaagctccagcagaatcagcggcagtaatgccggcagatattccataagtgtatccattatgctctctccttttcagcctttagcttctgcaagcaggcctgataacgcggttcccccttcagaaaatcgaatgcaggcggctgcagctcctgaatcagcgagtccagaataaccccgccgtctctgggagcctgtgtgcgcagctgtaaagattccatccaggcttccacctctgtaaaatacgtatctctatgaatcttcatatgggcaagatcgtagcggataatcacgtcgatcagccgttccagcattcgcagtgcggactccttatccctgcgctgtgcatagaccatggcacaggacatataaaccatcgtggaggtgatggtatgcagtgcatcgatatgaaacagcttcagcaattccagcatacggtgcatggtctcatcacacagctgctcatcctctgtattcatcatcatatagttggccatatcctgtattacgaacaacagatgctgatagatgcagatctgaaagatacggctggattgctttggctttcccagcatctgatagcatgccgcaatcatctcgctgtcctgtgcgatcggctttgcctcttcaccgagaagctgcaatgccttttgcggctgtctgctggtaatcaaataggttattttcaaagaaatcgcatcctttaccagactgttttcctcactttccgcaatcacgcggtcacacagctcctcactgcgcttcataaccagttctggtttttcatgcagcatgtagtgattgagataaagccctgccatctggagcaggaagggaaagcaggagtaatatttgcgtatcagctcctcactgtgagcatacgcattggcgctgtcccggctccattcagcactgagctgcagatacagcttgtttacagcctccatactcagctgcggttcatatccgatcagctcatccacactgacattaaacaaagtggccagctggggcagcagcaggatatccggcagggtcgtttcggtttcccacttggaaacactggatttcgatacacccatataggcagccagctcttcctgcgtcatgttcgcgtctcttcgcagcgcgataagcttttttccaagtcgaatcgtcgtcattgttcattccttctttctgcttttattatatcgtttccccgcagagttacaatggcataaaacgcaacttcaggaagaaatatttcccagcaggaaacaatatatgccggcaaagcatacttcttagtctattggttcatctatatcaaatagaatcctttccagacatatgccattcccattgacacatatgtgattaggcctgaaatcatataagtattacaaacggctctcataacataaaaaaacagcttctcaggctgaggctgctttacagcttttatctgaaggtacaggtgtattctatgctatgcattaatgggtgatgggtataaaatatccgtttgcttgaccctgtctgaaaaaggttcaagcaactgaaaacactacatccggctgataacagacagacgctttccaacacctgcaaaaaagggcacaaacgtatgatcgcgtcgtaccctcctcacagcgtatttatcctctagttaaaataggcgaatcctgttttataacggcttatagctcttccccattggatgcaatcacttttttataccagtaaaagcttttctttggtgtacgctcatacgtaccgttgccataatcatccaaatccacatatacaaagccgtatcgcttggaaaattctgatgttgtctgtgatacaagatcaatcggacaccatgcggtaaatccgaatacctctactccgtcacgaattgcttccttcacctgtgtcaactgcttctgcaggaaatcaatccggtaatcatcgtgaaccataccatcggcttccacctgatcataggcaccgaagccgcactcggagataaagatcggcaaatgataacggtcatacatgtgattcaacgcaatacgcataccgattggatcgattgcccagtcccacgcactgtattccacatatttgtttttctctgcccccattaaattggaggtatgcagctttaaggaatcaccgttgtatcctgatacaatactgctgtaatagctgaagctcatgaaatcaacagtcccctttttcaatacctcttcatctccctcctgcatagtaagaacaacgttattctgttcaaaaaagcgtttcatatagtatggatattctcccttgcactgcacatccggaaacagtaaatccataccggtatcaaaaagctgctgcagattatcctgtggactgcaggttttcggataatacacctgcttgctttgcatattccctacctgcaatgtttcatcaatttcatgtgctgcaagaacacagcgttctattgtcatattctgccgcaggcattttctttccctcctgcagtatctatatggaatatttgcaggagaggaaaagatactgccatgaggaaaagtaagctacagcaactgcggctatatgtatatccgatatacacgatactgtgtatttatttactattatcctataaaacaaaaaaagcgctgatatagagcgcttttgtgcttatcatggtgcaggagaagagatttgaactctcacgcgattgctcgcactgccgcctgaagacagcgtgtctgccgttccaccactcctgcatgtttcatgatgctcaatcataatacactgaaaaaaatgatttgtctacccctaaatggaaaaaaatcatttttttaccttactttccctgcaatgattgcaaatgctggcaggtatcccatgtgtgcatggcaggacatatatttttcaaaacaaaaaaagacgctgatatagagcgtctgactcaacaaatggtgcaggagaagagatttgaactctcacgcgattgctcgcactgccgcctgaagacagcgtgtctgccgttccaccactcctgcataattgagtgccctacaataatacactaaaatctttattttgtctaccttaaaaacatattttccctatgaaatttcatttcgtttttccttactatgatgcctcccccttgtctgcatcatcttaccggatgattttatatgcttcattaccttttaagcgccagtacccttttaacctgcgaatgcaatcaccatacgatagccgcttattctccagtttctgcgtgtcttttatacaagaagacctgtctgctattcttttatgaattacctaatgttcagaaatttcaataaaagacatcaaagaagttgacagatcatgcagtttcacagattctgtataaaagaacagcctgtggaatgcaagctgttccaaatttattgcgataaagcaagttgttgaagcattcttatgttttctgcacgtttttcttcttcgccagtactgcctgtatgagcatctgcattcaaagaaagccctatgccttcctctatatctgcccgatattttaaagaaggatacacgatatctctattgctttcaaattttgatgccgatggttgaccagctttacatatgagaaaaggtatataccgttttctgcttatacggatgctgtgcatcataaaatggatgcacttcggcattcctgatatttacaccgtttggcaggtcctgtgtttccagtgccagagcgataaatgcctctccccttcgatgatgattcaatacaagattctcatcatcaaaataatttgcactatacaaaaccagagaaggcgcatcagtagtcatatccagacgtcttccacttcctgcatgatataaggtgatgccgttaggccccagcaaaaacggggtatcgtatgctctggtatattgaaactcgggatggccaagctcgtagcgcttttgtatcggtgtcagattccggaaatcaaaggcacttccggctccaattttctctttttcaaacggatgtccatccggatgaattttcagtttttccacactgtcaatacgcaggtcatgctgcaatatggattcccgcaaatttcccgacagattgaaatacatatgggaagtcatattcatcagcgatttctgcggaggtgtaccgtgatattctattatcagattgtttccactgagccgataccatatatcatagcggtaggtaccctgtggaaatccgtccatgtcatgacggcattccagatgaaaatgcagtgcctgttcctcctcttcaacatgaaacaactgtctggatataccacccgtaccaccatgcagatgatgacagccgttattgattgaaagctgatgaacggtgttctccatcgaatagctgccataggcgattcttcctgccaccggtgcgacgactgcattcagatacggcccctgctgtcgctcatagtccatgatatcggaaaaagcagcgaccacattctccatattgccgcttcgatccgaggttttcaactccgtaatcacagcaccgaaattcaaggctgtcatatgtatagcctcattctgaattgtatatgcataaacagcaccttgtgaaaattctgcaaccttttttttcatgatttactccatttctttttcgcatattgcgcagacacaaatataaaaggacaacgcagtgatatccatgtgcatattgctgcattgcaccttcctacacaatcgaagcaaacatacagttcatagacccgcagccttcagtacctgtttcaaatgatgttccatatatgcatgcagcaaaggatgtccccaggaatacagtcagatgtttctaaaaactttccaccccgttttacaggacattgcattctgtaccattcctcagcaaaacgtaatctcagctttcacagctccgccagtttccctgcaccgtcaccaatggatgcgatatagaaatccggttcatatccgattgcctgtgtatactctctgcgcactgcagctgtgaagtcctcaatatcatcatttctgacaattgcaatcgcacagcctccaaatcctgctcctgtcatccgtgccccgattgtccctgactggttccatgcactttccacaagcgtatccagttctatcccggtaacctcataatcatcacgcagggagatatgagaggcattcatcaaagcaccaaattcttcaatatcgtttttttccaatgccgctatcgcttttttcacacgtatgttttccagcacagcatgacgggcacgctttctttccaccggactggtgatgatgtgctgcaccttctcaaattccgtttccttcagatcacataaatttttaatcttcacaaccgtttggagctgggaaagcgcatgctcacactcagcacgtcgttcgttatacttggaatccgtcagtccgcgctgcttgttggtattcatgataacaatactagcctgttttagctgaacgggtgcataggtatattccaatgtgccggtatccagtgcgatcgcatgatcctttttccccattccgatgataaactgatccatgataccacagttcatgccgacaaactgattctctgctttttgcgacagcttgataatatccagcttactgatgggaagctgaaaggtttctttcagaattgttccagtcagtacctccagcgatgcactggaggaaagccctgccccgtttggtatgttgccttcaatcagtatgtttaaaccacatggaatttcaaagccttcctgctgcaggaagtacaggacgccttttacataattcgcccagtcatcctttttatcatagtgcagcgtttgcaatgcaacgtcaataatccctttctctttaaaattattggaaaataaacgcatacaggaatctgttcgtttcgagacaactgcataggtaccaaacgtgatggcacatgggaacaccatgccgccgttatagtctgtatgctctccaatcagatttacacgtcccggggaaaagaacaatgcctcacccggtaccatgagcaggattgcacctatatttccgtaaccttcgattccagacttctgtccggatttgaagggagtctgatacacaggaaatatgtgaagccgcttgtgaatgacctctccctttcctccttttgttttaacggcagtgcaccatggcattctgctattactgccgctattcagcacattgctctatacgatgaggaaaaagcggatgcctatgaactggcaatcctgatggagctttatacgatattagaaacactgcatctccatatgcatcctgcacgcaagctttcaacctctgatatgctgaattacgatagaatccgtaccattctgctgtatgtggaaaacaattacaaccgcgagctcaccctgcatgatattgcaggtcagattcatgtctgtaaaaacgaatgctgcagaatctttaagagctatatgcatcagtctctatttgagtttattctggaatttcgaattgagaaaagtatcggctttctcatgaacggctcttattccgtttcggaaatttcgcagctgtccggattcaatgactccaactatttctcacgggcgtttaaaaagcagaagggatgctcccctctgcaatacaggaaaaaaatgaaaacacaaggctgaagccttctaccttggttcatgtttctgctcccttgaccatgtccaataaaagaaagccagaaccgattttataatattcttacttctacggatatttctccggatgaatactgctgtagatcattttttcaaaattttgaaaacccgtacagcttcgtatgagcggcatcatagccggttcactgaacagagaaatcagggattcataaatacttctgaattcccgcttatcggctttgtttatcgccagcaaaaagataatatacaccgtattggaccccactgaattccgttttttgatatcgctacagcaatgcttgtcttcatggcatccatttcaaccgcatgtggaattgctatccccccaaacgcggttgttgcggcattttcccttcggcacacgttatcataaaaatcagagtttacatacttcttttctgtcagtgctgcacataaaagttgcaggatctgttcccttgatgcagttgccggctcatacagaaacaggtctttttcaaaaaaggtatgaaaatcaacacatagcttctgattcttttcctccttcagctcttttgaaataacagactgtatccgatcgaactgtgatgtaagattgatcggagatatttgcaccacctttgaatttgcgtaatatgcgtgctgtgttagcggaattgtcgaaaacacgattgcaattctttgctcccgcagcttttccctgcattgggtttcatccgtcacagagccgatcagattcagctgattaccaaaattcatcatcatggtatttaagattcccgatgccatatcatgataatccgggcatatcaaaatcgccggtattttatatatgtttgctgactgcctctctatctcagcaccgatatgaatcgcaagaaatgcagtttcatcctcattcaccataaaatgataacgatccatcaaatccagtgcaatataaatagcaatatcaaatacgatcggactattgttcttaatcgcctgcgtcatcggattctttgtggaccgccctgtttttgcacgaaagatcagatttttcagatgcagggcaaacggtgtgataaaggtgtttgcagaaagatcaatcatatacagattatcaatcatacggacatactctcttgtcaaggcaagcacatcctcacctacagcattttttaatgctgtaccggatacatccaatgaaaaattggcatttgcgcgaaacagcatatacagctcaaagtattcataatcattaaatgcaataccgaacctttgttcgatctgctgcctcaggctgctcaaaaaagcttcctcctgtggtgaagtaaacgtgaaatccgtctgtccggaatccagctcctttccattcagctcccgatcaatcataataagaagatgcaaaagcagattcaaggcggcaaaatcatttaaataatacgtatattttttaaatgtctgatatatgattgtctgcagcgcatcaatatctatactgtcaaaatttttgcgcagtaaatcaagattgatatagctgtttttcgcctcttcattgattacataactcatcagtctgcgtttatccttctcacttccctgcatatagacacagtcattttcacagggaatgcgacgtgataggcggaaaagattttattcattttatagattacggttttgactgtggagtagctcacacaaagcatatcgctaagatcaaatacattcaatccagaatggtgatgcagcatgagctgtttaatgatataaaaggagcgctcctcctgtgtctgcggaatcttttgatcatcaagagcagccaataaggaggacaccgtattggtatgcagctcatagccgttgcgtgaagatgcgatgatactttttccatacagtccgtttatctcatggacgtaattttttatcgagcgaggagtaaccttaagcgcatttgcaagctccttcccgctcatcggccggttatgaatagataaaaaacgaatcatttccaattgtttcttattcatatgtaaaacctcctgctcatttatttcattataacaattccaacagaaattacaactttgcttcttcctgtaaggggaaatcacatatttccccctgaaggaaacattcataccttccctcctttccccgtaaaggaaaaagacaggttgatgaaatctatcaaattccgcataatgtaggtgtcaagaaaaacggaggtgaaaaaatggaaaccttgaaaatactgctttgctgtggtgccggtatgtccagcggcttcttagccagcagcgccagaaaaacagcgaaaaagaaaaagctgaacgtaacgattgaagcacgcagtgcttctgaggcaaacgagctgctctccaccattgatgttctgctgatcggtccgcattatgcaaaagaaatcaataagtttcaagagcttacaaatccgcatggtgttgcagttgcgttgataccggaagacatttacggttctctcgacggtgagcgcctgatcgcttttgcacagactttaaagaattaaaaaagctaagagggcaatcttagcttcatgagaaatcgctttgcattagatttcttcagaaacagcatacatcgattctgaagaaatagcaataaaaacaggaggaaagttatgaatacattcatgaattggctggcagattcctttgtgccaaaatcaaacaagatattaagcaagccctggatttccgcattgggctccactatgcagaaggtaattccattcattttaacaggctccgtaatatttctatacaatgtgcttgtgtccttttttccatcactgccggatctggggccgatcagtgatttcagctttggcatcatctccctgatcgttgcctttacaattgcgaatcagtgtatggaaaagctgggacatccgagttatatgatcaacgcaggtatcgcttccatcggtgttttcctgatggtcgcaatcccgatcggtgaggatgccgacagcatttccgctctgatgaatcatgtaagtgccagcggtattgcagttgccatgattacaggtctgtttacctctatcatctttcacctatgggcaaagctgcagtttctgaaggacagcagtattccggattttgtttcttcctggatcaatacagttgtaccaaacctcatttcattaggtgtcatcatgatcatggtcaagcttatggaggtaaatgtgtacgctgccattatatcaatctttacaccattgatacaaatcggtcagacacttcccggtctggtactcatgtgttttactctggctttcttctacaccctgggtatttcaagctggaccttcaacgccatcacaacaccgattctcatggccggtgtgcaggccaacctggaacagattgctgcaggacaggcggcaacacatatcgtcagccatacgaccttctggtctatcagctttatcacaatgggcggcgtctgtgcaacgctggcgctcaatgtcctcatgtgcttttcaaaatcaaagcagctgaaaatgctgggaaaagttttccttgtcccttccatcttcaacatcaatgagccgttaatgtatggcgcaaaggttgtcttcaatcctctgctgatgatccctgcatggatcaatgcgattgtcggaccagtctatgtctgggtgattatgagcctgggcttactcaacatccctgcacaaatgatggaaatcggacaggtacctgcaccaatttcttctgtccttgcaacacaggatatccgtgctgtcttatggtggatcattttattcctcatttatggaatgatctggtatccgtttttcaaggtatatgagaaacagaaattaaaagaagaaacgacagcagctgtcgaataacaatacatacaatacggaggacttcttatgaacgaacaaaacgaactgcttacagcagccatgcagattatactgcatgctgggaatgcccgtaatgctgctgacgaagcattggaggaagcaaagcgctttaattttcaggaggctgcttcacatttacagaaagctgaggaagcgatcacactggcacataagtcacaaacggatatcattcaaaaggaagccggtggatatggctatgaaccaagcctgttatttgcccatgcgcaggataccctgatgacgattaagtcggagctgcatttaagcaggcagctgattgatgtattaaaaatcataaagaataataaataaagaagtttgcagaaagcacatgaattgcatcacatacaaaggggagcagaaaggatgcccctctttttaaaatagaataggagaacagagcatgattataaagcaacatgatattcacgataagtttttgtggggcggagcagttgccgcctgccagattgagggagcctatgatgtggatggaagaggcttatccacctccgacttgcgagcctatgatccgaatttaaaacgtgccgatataaaaaaagaaggcggtgataccctggccggtatcaaagctgccatgcaggatagcatccgttattttcctaagcgctacggaatcgacttctatcatacatataagcaggaccttgccctgttaaaggagcttggcctgcaggcatttcgtacaagtatttcctggagccgcatctttccaaagggggatgaaaaggaaccaaatgagaaggggctgcagttttacgatcagctgattgatgaaattataaaaaatggcatggagccgatcataacgatgagccattatgatttcccgatccatcttgttacagaatatggaggcttcgcgaaccgcaaggttattgattttttcgtaaattatgcaggtgttctacttcgtcgttacaaaggtaaggtaaaatactggattgtttgtaatcaggtaaatctggtgcctgcagttcaattcggttctctgggcatttacgaggatcaaagtgagcatatggaagagctgatgtatcaggcagtgcatcatcaatttgttgcaggtgccagagtgatacagctggcaagagaagtcgatccggatgcacacatgggaacaatggtggcagatggcaccttttatccggctacctgcaagccgcaggatgtgattctgaccatgaaaaaaaatcggatgcagtattattttacagatgttcagctcaaaggcgaatatcccggatatgccctgcgttatttcaaagataacgatatccacctgaacatacaggagcaggataaaaagctgttaaaaacctatacgatggatttcttggcagtatcctattattattccaaaatcgttgattccgataaaaataccatgaaaccctttgacggggaacaaaatccctttctgaagccgacaccatgggaatggcgtgctgatccgctgggtctttataactgtctttcacaatactgggatcgttatgaaaagcctttgatgatagcggaaaacggcttgggagccttggatgttgttgaagaggatggaggaatacacgatacataccgtattgaatacctccgtcagcatatcatacaggtacaggaatgcagaaaggatggtgttgatattctggcatatctgagctgggcaccgattgatatggtatcctcatccagtgcggagatgagtaagcgctatggttatatctatgtggatctggatgattatggtaaaggaagcgggaaacgattgaaaaaggattccttctattggtatcagcatgtcattaagacaaacggtaaagagctgtaaatcgaaggaaagtttatggttatttgattcagcatcctatgctgcacaagaatgtatctgctgcttgctataaaacttttgcatcctacaaaagaaggctataccctgcgcgtgttgagccactccatgtatttccctttttcatacagatcgtcctctcttgacattttttagctcaatgttatgataaagaaaaaaatggaaaggaagtgctgtcatgaaatattctgccggtatgctggatttgctggaggcacttacgctacctgagcagcctgttttatttctgaagctgacgatacagccccatatctgtatggaaagattaaaggatgcagttagtcagtgtatagcgtttctgcccgagcttgctttacgctatgataaaaagcataactgctggaggaaacagaaggacgatactttttctatgattcaggaggttgaagactttgacttttcaagctgggacattgagcaccatgcacagctctgcatacagattatacataaagaacagcaggaccttgtatgcatcggatacagtcatattctgtgtgacggggatggagctacacaaatccttcgactgctgacagcctgttatcgccaggagactgtctcctttcaaaactgccgaacccccgaatcccttccgatcataaagctgaaaaaaataaaaaccaaaagaagaaaaacaattcctgccgcacttccttttgctccccatcccctgcataccagcgagctgcatcaaagcattccacgaaagctgttacagcaaatttgtccatctgcctgtacagtgaacgatgttctgctatgtgcctatgcccagacactgcacagcatctccgcagcgaatgccgtgacaattccctgtccggtaaatcttcgttcctatctgcagaaaaagccaagctggtccattgcaaatttcgttggagattttcaggtaacactgcatggtctggatcatcgcgattggcgggagctgcttgcggatgtccatcaacaaatgcaggaggaaaaggcacgctgttctgacctgcataccatacagctgttacatccgattatgaagcaccttcctcttgccgtcacaaaagctgtcgcaaaagcaggctttcactcaccggaaatctcctacacaaatctgggaaagatcgatgcggcatccatctattttgacgactgcacgattacgcagctgtatcttctgggcagagcccgcatatacccgtcctttcagatatccgtctctacatggaaggatacctgtaccttagcctgtcatgtcacaggagacacgttacagctaatgcatgcacagagaattcttacaaccatgtgtagactgctgcatacatatgccggacaacccgtgtccgaatcaaaaacagaatgacctctgccattctgtttttctatatgcaactacgtttccacttcatcattccacacgcgatctgctatgtaaaagacctgtatacgtacagaggtttctcccggacatatccatagcaaagcagactgccgctgcaagcattaagccaaaaggtgcagacagcatgttgtccttccatctctgccttttgaaatactgtcttcttcatcaaacgaaattgaatcctaaacaactgagagtcgtatcactttttgataaatgtaatgatgacacagcatgccatgaatatggcagtaagaagcagaatccaatcgttgtgtgtaagcagactgcatacagtaaatacaaatgcgactgccattatgattctgtaaaatactttctctttcattttcagcttccctttctttaagatatacaaacggacttatccatgcatccggcaggtaacgtcttatcacagcaggcctgagacgattgtctttcacttgcatcgtctcgcgttttaagccctcatcctcgccacttcttccctgctacctgcaaagcatattctgcttgatcatttccaatgccctttcaaaaggtacgcatgacgcatatcggttcttccaaatgaaattattgtaataatcataggttttctttgccgacatataatcgttatccaccgtgctgtttgtgtaagcaggaacaatcatgtgaaatccatgttcaaatccgcatatgatcgttgcattgatacaatactctgtctgcaatcctgtaatcatgatcgtatcctctcctttatctcttaaatattccgtcagtcctgtgtctttaaaagcgctgtttacgttcttatcaactattttttctccgcaaagcggcttgaattcatcgtatatgtcaaagccctgtgcaccctttgtcaacgcattttcagcaccatcatcgtgacgaacatacaccacctcgacaccatgccttctggcctgcgctatcaatgtttttatgcggctttcaagaagctgaaattcatataatgcttcattcataatcattgtctgcgtatccacaatcaaaagtaccatttgttttctccattctctcttaaagaccgtaatggccttttttcccttaacctgattattcttctgctattatgcattctcacgatttcgcccggagcgcctgtaataccatatagctgccagcatggaaatcagaaagaagatacctgcatacaaaaaggataaccgtggtcccgctgcatagataaatcctgcgaacaatgcccctgcgatcatccccagacttttcatcgcattgtaaaagcccatgaccatgctgctgtgctcagcactggatgccgaagcacaaagatcctgcagtaaagggatataaatagcatttaatgcaaagaagatgatattgataaggataaacggcaaaatatcctccagcatcgttatggcaatcagcgtgacaccggctcctcccagcacatagatgacagatttcttaacgttggtcctcttcatgatccatacacagatcgtagtattggcaaacagcgatataaagccgaccacagccttcagcataccgttataagaggaattgaaatgaaactgatccttaataaaataattgaaattctgatcatatgccgttgatgccgttgaggtcagaaaaaccgcaaagaataaaacagcgaatgtcagcgtcataaagcgacgggcatccagaaatgcctgaaacggatttgcttccttccatatgctgacagacttgcctgttacctccctatcctctcgcagacatatcgcaaacagcataccgcacagaatgaggacaccgctttgcaatgcaaaggtcaacggaatggaaacgacaccggcaaacccgccgatcagatagccgaaagccgcaaatacggtcgtgaaggtagcggataacgccagatagcgccccctgttctccattgtgcttgtatgaatgatataggtcagaaagctgaccataataccaccgacaaagaatcccgataaaaggcgggcaagcataatggtgggaagtgttttcatgatggcaaacagcagctgtccgatgccgtagcccacacagcagatacccagaacccggcggcttcccatacgcgtgacctgctttgcccagaagggagaaaacagaaaattggtgaatgccataccggcatacagcataccgaaggaataatccggtagctgaagattctgaatgagtgtcggcgtaatcggatgtgcaaaattagcagccagactctccagagcaactgcgaagaaaaacagctgcaaatgatatttagacagaaatgatttcatggatgaattgttcatatatcgctcccactttctacaacatgtcaaatcttactatgaatacggtggaaaatcaactgagaaactacgtatgctcataaaaaacagatgccggtttccaatggaatgcatctgcttttgcttatttctgcttaatatatttctgttcaaacatagagacaggaatcggacggtcgattaaatacccctgcagaccgtcacagtccagctgctttaaaatatcaaattgctcctttgtttcaactccctccacaatcagctgcatctgcagattgtgacagatttgaacaagggaggatatcagcatctgtgaacggcggttattctgcaaatcctgcatcatactgcgatccagcttcagcgtatccagctgcgcattgataaataaggccatattggaatagcgtgcgccgaaatcatcaatggatatggaatatccctgccgtttgatgcgctccattatcataatcagaaattcattgtccagactctcgtcattttctatgatttcaatctccagatactgcttgggaacattgtagtttccccagatgcgttccagttctcccagaaaatccgccatacgcaaggtgtagcgtgaaaagttcacactcagcggtgtaagtcttctgccttccgcatgccagcggctgagcagtctgcatacctgttcaaaagcaaagaaatccaagtaccggatcgtgcgtgcctcctccagagatggaataaactcattgggcataatcagggtacccgtttcatcgtgataacgaatcagtgcctctcctccgataagctcctttctgaaattcaccttcggctgcagatacacctcaaagcgctgattttccaatgcctgcatcaagacggagcggtccgcaagctgcaaaaccgtatcgttacagcagcggtaccggttggaatttggatttttccgatagaactgcattttatcctgatacatgtattcatctgcatctgttatcctggaggatatatcctgacaggtggatgtccatatatgtccgattgcccccttgcaattcgcactgccgatgattgcctgcttcagaattcccacctgctccagaaattcctgttcctgcattccctgaacaaacacaacgaattcatccccgccgattcgatagatggcgccggtgttaaacacctttttcaatatggatgctccttctgtcagcaccttatctccataggtatgtcccagatggtcgttgatatccttcaatccgttgatatccatatagacgataccaaggggaatctgcctgccattgagctgattcagatcctgaaggtagcgatttcgattatacacaccggttagatcatcgtaatagctgttatgcagcaggcggtcgttcaaatcctttttctccatcgccacactcatgaaatagctgatggtttccagcatggagaaattccgcatatagtcaggtgccggattatccacaccgataaatccgatgcttttattattctgaacgatcggagaaagcgcaatgctgtgtatattctgtacgtgcagcacctcataggtctgtggaaagcttttctgtatacgttccacatccggtatggaaacatttttcccctgctcgataaaatccttccagattgcgagcagctcaacatccatattctgacagaattccatggacgattccacaccatcgctgcaccactcataggtgttgttcatacatccattctgcagctcaaacacataggcgcgctctgcatgcatgaattcaccgatttctttcaacagctgatccatatagctctgcatatcattggatatatacatcagacggatacaggctacggttttcatttccatctgcagagccaaattcagacgctcatgctcctgttccagattctgacgaatcctcatcatatcctcaacatcggtataaacgacataaacgaccggtatgccgtcgatctgttcttccgcaaaggtaccggtcatatgaatccgcagacagctccctccttttacaggaaggcggcagaagcattcgtactgctgacttttgtttcgatatgcatgctcaacaatttccttcagcttttcaaaatcctttggggtctgctgaaaaaacaaggtcgcgctgtcatgaaacaggatgtgatattcctcttcactgtatccgcacatcgtataaaacgtatcatttgcccataatgttgaaaactcttcattgagaagatatttacacacgccgatgcgcatggcaccgagctggttttccgtatcttccttccaaatttgtgtattcattgtatcatcctttttttactatcccttgcttttttataaaaagcatacatccgcatatgtaatccattaccggaagtcttcctatgcttgtaacgttttgcgaaaggcttcccttcggccatgctatcatccattcaggtagctgatgaaatccttttgatacaggacataatcaactgaggactgctgtcttcccaactgatctgtccaggaattttcattcacccgcactctggtaaagccaagctgctcatacacatgctgtgctcttgtattggtaagattcacatacaggataatcctgtgacagccttgctcatgaaagagggaggatatcagcatactcaacagaacttttccgattcccttgttctgcctggaagcatcgcatagcttaatgcctatggcggctgttgcatcagctttccatcgcacactcatttcgccaatcgcgatatcgtccatttctatcatcaataagcgatgagatgtatcgcagttttttatcgtttccgcaatttcctgcaccgtttcccctgtaccgtttggaaatcctgcatgtgccatcaccctgccatcattccaccattgtgcaagctgcccggcatcctgcactacagcatcccgtatggttaagttttgatatctaagcagcatattcgtcctccaagcagtatatacgcttattacatgtgcaggcatttctgcataccgctttcatagtgtcagttctattgtataccgttttttccataaaggatacttttttaaaaaaatctttacagaattgcatttatccacgtttccagaaggcttatccagccttcgcattccggctgcagcttctctccgtcggctcgctgactcagtctgccggctgtagacaggccatgtgcacctttatcatacatatgaaattcacacagcacacccttctttaccaaggcagaggcaaacagcagagaattttgtacggaaaccgttggatcggtataggtatgccacagaaaggttctgggtacatccttatgtacctgcagctccagtgatacatggtttcgcagctgctcatcctccgcatgctcctgcaatagattttgtatgctttcctcatgtgcataggcacccgcagtgataacgggatagcatagaatctgggcaaacggacgcaggtccgttctctgaatatattgtgtgattatcggctgattccagtttataccaagactcgccgcaagatgtccccctgctgagcagcccataagaaagatacggtcctgacggatattccaagccgtgcagttatccttcaacagctgaaacgccgccgcagcctcaagcagtgcccggggataggcagccggagcacaggaataacgaagcacggctacctgtaagcccatggcatttaaccgtatggcaagcggttccgcctcccgatcgctggtatagcggtatgcaccgccgggcatcagcagcactgccggacgccttgtgctgttcaacagctcctttgatgcatccataaaatacgtctgcaggactgctcctgttgcttttccctgcagctgtatctgaatcgtttctgtacgcatacgctcctcctatacaaaaagccggatatctccagcagatatttcttttatttcctgcttcccttgcgatatcgttcctgatcgagaaagaacatcgtaaaggttgcccgtgacagcaaaacatcttcgtcattgaaaataaaaacctcgtaaactccggtcgttctgccggctgatattttctgtgcgattccgatcagcttgccgcctcttcccggcttgatataattgatcgtaccggacaaggtaacgctgtcccgacccgaggtaaagctcgctgccccggctgcggtatctgcgagagaatagagtgcaccaccgtgtacaaagccatgtacattcaaaatctgttcatcaatgatcatctcaaccttcgcatagccttccttcacctccacgacctgcatatcgttgctttgcagatattgagaagaggaattcaggcgcttctttaattcatccattgtttccatgggaaagtctccttttttacataatacaataccttctgtatgctcatcattataccacgatgacctgaaaaagcgcagctatttacaagtccgataacaaaaaaacagatgttactgagttatttttaaaaacaagcaaagcatacagcaggaagcgcatgattcattattggagaagaaaatccaatcatgctctatatacatgacagtgcatctgttttcgtcttgcagcgccatgatccgtgcggttaccttcggcatttcatgtatccgcatgcatttcaccgaaaggcatcttcctgctgttttgagaacagcgaattccatctctgattttattgtaccctcttcgcagatctccgccttatgcgaagtctattgacatccggaaaaatatctgatagtgtcttactgacaggaggtgatcctatgctgacaaaagaacgcttctttcgcattctggagctactcgatcataaatcgttcattacaatacaggagctgatggaggttttaaacgcaagcaaatccacagtcaaccgcgatctgattgagctggaaaagcagggattgatccaacgggagcgcggcggtgctataaaaaaagaaatgcctgcgacactcagcagttatcgggagctgcccgttatggataaagaacatattcacagtgcggaaaaggatatgatctgcgcacaggcagccgctatcgtaaaggacggggattgtgtgtatgtggattccggtacgacccccagctatctgattccatatattgcaggtaaaaacatcaagcttgtcacctccagcatttatgcattacgcaagctgcctgcctcctttcccggcgagctttttctgattggcggaaaatacgacatgcgttatgatatgagtgtcggttaccttacaaccgagcatatacgtaaattccattttgaccatgccttcttcagtgcaagcggtgttgagctggattctcaggaggttctggctattgatttcacgataagtgaagtgaaaagcacggtgctgcagcgctctcgctcctcccatcttctgattgacgattccaagctttccatacgggcactttgtacatgggctgtgctgtctgattttcaggatgtatacatcaatgcctttgaggccatgcgggaaatggagctgccgcagcatttcatcatttgtaaatagaactcattgcagttcttttttttacgctgtcatacagtggtaaaacagctgcggcacgactgctttcacaatgtctaacacccttgcagctgctgcatagtatacgctaaagggggaatgacgatgcatgtactatctgccctgctgtttgccgtatctgcgaatatcgactgtcttgccataggtctgtcctatggcatccagtctgtaaaaatcgatgctcgaagcaatttgatcattgcagtgatatccactgcgggtaccctgatctccatgcttgcaggaaaaccgctggcagcactctgctcagcggatactgccaaccgaatcggagctgtcctgctgatgctgatcggctgttggattctgtttcaaaatcacaggacacagcagaaaagtctgaaggcatatgaccgtgatgcatccagcagaatcgaccagaaggaagcggtcgttctggcatttgcactcacgatcaataacatgggactggggatatccggaagcatcaccggactgccgattcctgtaacctgcctgtttacctttctatgctcgctgctgtttatcgctgtatcgcaaatcgcaggaaaaagctgcatagcttattttattcataaatatgcaagagatacagctgcgtggatgattattctgctgggctttcttgaatgatgtatataaaaaagcctgcggggtatcagggttcttacttcagggtgtttgcaaaagggagaatgcaaccctattgataaatacaatagggttaaatcctcctgttttaaatttactcaccatcgcgtatgaataaaatcagcttcgcatactttttttcattatgaatgacagcagtgccaacgaagcaaatgcgcccagataccagactgccagcacacgcagctgctgtaatgctgtatgcagcagctcctccatctgcacataggatatccgcacaagcaaaggaagtacatagctgatacacaaaaacagcaaggccgcaaacaggcagctgagcgctgcatttcgaaaagcacgatacctccctgatgcagaaaccagcatgcttacaaaggataccagcatagctccgcacagaagccggatcgtatcattttgcataccgaactgcacaagccgcacagccagaagggcgggtacgctgagggatgctcgtgtatcctcagccagtgcagacagacgggtgttcaggtgcagctgacgggttagaatctgaagcagcagcttttgctgggaggcagttagatttatattctgaaacagtgccgtttgctcctttgaaagcagatctgaaaactgtgcatccaaatccggaagctgtgctgtttcatccgctacacattgtataaaggcaagtccggcagtatccagaaaggatgtccagtccgattgcttctgaagattctcctgcagcgtatcaagctgctgcaggatggactgctccagaagaaaacagccaggcacctgttccagcgcatccttaagcggctctttgatatccagatgggaaacgacaagcgcactcattccctgttccttcacctgccgcagggtcacagctcctcccaaaagcaatgcagtgcagagaaacagcagtgtgctgacccataaaagaagtcttctcatcctgtcacctcccggcgttttttcctgccagctcctatttcgactacttccttcagcttcggataggcgtataaaagaaaccgttggtagccgcactgtgtttcattcataaaaacactgcgcagacgtttgcagtttccgtggcacatcggctgaaatggacaggcagcacacagctgcggctcttccctgtatgcaaacgccttcgcgcggctgcaatcgcgtgccgcaagcagatcggtatccagaacattgccgcagtgatattcatccagtacataaaaatcacagggatacaaagagccgtcgctttccacaacatactgaaactgacactctcccagcattccgcaggtacctggtgtttttccctgcaggagcagcagcaggttatcaaacagggcaacgctttgatactgcttgttttccacatcctgtatccagagatcaaaatagctgcggtaaaactgatagaacagctccggtgtcagtgaatatgcactctgtttttcctgcaaaggggcaaggcagggaatcagctgtacatgggaaaagccgtgctccttataaaaggcaaacagcttcttcggctccctggccagctgcctgcttaaaacgctcagaatattgaagtctacatgatgtctgcgtaacagctgtatggcacgcatcacgtccgcatacgtaccggcatccttgcgttttcgatacaaatcatgctgctttcgccatccgtccagagatacgccgacaagaacattgtgcttatgaaaaaaggagcaccatgccgcattcagcagacagccgttggtctgaatggcataccgcacattctgctttggctggcgaagctgttttacggcatccgcaaactgctcatagaagggcaatccggcaagcagcggctctccgccctgaaaggcgaaggtgatatcggcatccgcatccgcagcttgaaacaccttttccagcaatgccacagctacctcattgcgcatacgcccgtagttcgcactgcttcgattttctgcaatatccttatagaagcaataggtgcagttcagctgacagcctgcggataccggcttgaccagaaatgataacgtcttcatatgcatcccttctttccaccgctaagtatagcatgtctttatagtatatcacaagacagctgctgctttcaccttgaagcaaagccatgaatttctgcttcggttctcactttcggacgcttcctgcatggtacgatacagacttttcatctgatatttatggatacggtgatgtacatgtgctgtatgaatcattcaatccgcctggacaggatgaaaaattctttcgaatacatcacgctttcctgcccgacggtatttttttcgagcattcaccgctctttcgctctgacatgcatacgaaagcatcaaaaaaagattctttactgacagtgtgcaagatcaaaaaggggaatgcaataccactgtaacttatcaatgatatttgaatatccctttttcaaacaccagaacgtaaggaaacctcacaaaaaaagcatcctgcttctttgtatacgccttgaagcacaatgcttattgtctgttatatacatctcttttttgatgcctatgcctcttcgtcttcaaacggatagcgcattccccactgtctgcgtacttcatccatcagggctactacatcactggatagcttcagggtgctgttgttcgctgttgcgctgacggcagcctccatatcccgtagctcatataccagtgcatcactgcgtgttcccgcatccagtgtttctgtccagccatctcttgtatagcggatctgaaggctgtctgctcttggatattcacggatttccagatatccctcttctccggcaacaatacctacctttggcagcttggctcgcatggttaacgtaaccgtagccatttcatccagtgaattgcgcaggatgaaaccgctcatttcatccacacctgtttcaaagggaatcatattcgtgagaacggtatcaggctgtgcatgcagaaaccagcgcacaaaggataacgcataggtaccgatatccaaaagggctcctccggcaagctgcggggaaaagaatctgttcgtgacatcgtattccttacagctcccaaaattaacctgtatcattttcagcttaccgattgcgccctgctcaaccagctcttttgctttggcaaacaccggcatgtgaaaaatcgtcattgcctccatcagaatcagctgcttcttttgtgccagtgccattgcttcctgcagctgtctgtggtttactgtgattgccttttcgcaaagtacatgcttgccatgctgcaaagcgcgcatcatatagtcataatgataggtatgcggtgttgcgatataaatgatatccacctgctcatctgcaagcagactttcaatatcataacagtgctcaaccgtatatgcgcttgcaaatgccgttaccttctccatatgacgtccagcgacggcataaatcgtaccatgctccttcatcagcgcctcggccatctgcacggcaattgcaccctgaccaagaataccccagttccattttttcatattctcatccctttcctgttcacattttaaatatccgcagcatgctgtggaatacacgcaatctgttatttcttatcagacactgccttttttcaatagctcaaagccctgatcgctaacaaccagaattgcggtgacctctcttgtcagcagggatgtatcaacaacccccgcaatgcttttcaatgcatgattcagtttcttcggatccccgaccttatcaaaccatacatccgccagtacattgccatgatcactcattacagcaccgtactttccttccccatgcttacagacaaagcggccttgcagctcctccactctgcgtttcacataggctgttgcatcctccaaaagctccatgacaaccggtacatgaaactgcagggtgtctgaaagcttgctttcatcaatcagcagcatatattcctctgccatattggcaatcagcttctcccggacatgaattccgcctccgcttttcagcgcataaaattgacggtctgcttcatcacagccgtcaaaggcgatatccacatgggatatctgacgcagcggaagaagcggcagtcccagctttatacaaagcgtttccgtttccagagacggcgttacgatttgcacctgctttccgctttccttaacaaagcgtgcaagatgagcgatcgttgatccccctcccaagccgattaccatgccgtcctgtatatatgccaaggccttttgtgcacaacgttttttcataatgttcttatctccttttcctgtatctcagggcttgtatccctctgcccttagcaggcttcccgttccttcagctgcaccagcagctcttccaccgtttccctgtccgcaattcccttggaaaatgcactggcactgccacatgctgttccataacgcagtgccgccgcataggattgctcacgcaaataaccgtatagaaagcccgcaaccatggaatcaccggcaccgacggaattaacaacctttcccctgcaggccggtgcatgataaacctcctgtgtttcagtgagcagtaaagctccctgctccgccatggataccagcacattgcgtgcacccatcgcctgcagctccttcgcatagacaagcagatcctccctgctggaaagctctacctcaaacatttccgcaagctccttatgattgggcttgatcagaaacggatgatagacaagcgtggacatcagtgattcctgccttgcatccacacatacacggatgccgctcccctgcagatgctgcatgatatccgcatagatatcctgtggaatactgccgggtacattcccggacagcaccagaatatcatcctttttcaatcgatccagcttttttataagctgctccagatgcgtatagcgaatctgcggtccctgtccgttgatttcactttcctcctgcgcatgcacctttacgttgattctcgtaaagccctgctccaccttcagaaaatccggctgaatgcccatggccgcaaccccctgttccagtgcatcccctgtaaagcctgcgataaagcccaatgcacaggatttcatcccaagctgtgccagcatactggatacattgattccctttcccccgaagatcagatcctccgccttggtgcgcataatttcaccggctgtcagctcgtttacttcaaccacatagtcaattgaaggatttaatgtcactgtatagatcattcttccacctcgataatatccgcttcctccagatattccttctccacacccttgcctgtgatgatcgtcgcatcactgatatccgccgtcgtgatagaggtacaggttccgaatttaccggaatccgcaagcacatagcacttctgcgcatgtttcatcgcctccatcttgacatacgcctcattggtatccggtgtggtaaagccgctgtccaccgttataccgttggttccgaaaaatgccttgttgaaattgtatttctgcagggaggaaacagcgccgagacctaccaccgcttccgttttgcttttcagctcaccggccagcaggaaggtacgaaagccctgcgcagccagccgtcttccatgctccagcccgtttgtcacataaattgcttcctcttccttcagatattccaccatgtgcagggttgtgctcccggcatcgatatacacaaagtcatgcgcctgaatcagcgatgcggcatagcgtgcaatccgctttttctcttccacatgctcctcactgcgcgcagccacctcagtttcatataacccgtattccttatgcagcagcgttgcaccgccatgtacctttttcagttttcccatcttatgcagtgccaccagatcccgccgtatggtggattcactgatggacagtgcctgtgtcagttccagaaccgtgacagttctctgcttttgcagaatggacagaattgccgcaaagcgttcttcagcaagcatcgtcattcctcctctttgttataagtatacgttctataatcgccattgtcaatcacattcagtcaaattattgcaggaatatttgaccgattatgaaaatatctgcaggttttcttgtctgtagcccgcaacagacattcgataatctctggtatatttagaaatatgacgctgaacaggaaagaccagggcagcatccgcactcagtcggtgtataggtaacgacagaaaaaagaagcaattccctatgcatgccagggactttacttcatcatattacagcttcttccattcccataatcacgcaaaacacattgtattcatctataaagaaagtacctatagcttcaacctgaccgccaaagtcagacctctctataggtacttttttcatattgcctttttgggaatgagtcgagaaggaaaacgcaatcaacgcctgtcggttgagagaatctgccttacttacatttcccacgattattttctgttttacggattactccttgcttataccttggaaaggatgaagcggcagcttcccttgatggtcaccttgcccgtatttgcactggcgaatacagaatctcccttgcggatgctcagcatggtatcatcactttcgatactgccctcaccatccacaatgacaaaggacgcaaagctttcctcgtccaccttcacactgcactctgttttcacatcatacacataggttgtgaaatattcgcaggtagccatcatggcacacttgtaggtaccgtaatccttctcttcaccaatcggtttgaaatcactttccagcggtgtcagattggaaacatcaatagccttctcaatgtgcagctctctcggctttccatccttacctacgcgtccgaagtcatacacgcgataggtcgtattggaattctgctgaatttcacagattacaattccttcaccgattgcatgaatggttcccgattcaatgaagaacacatctcccttgtgtaccggcaccttcttcaatacatccagaatggtgttgtcttcaatgcgtgcccggaattcatcctttgtaatttccttattcgttccataatacagactggcaccctcttcggcatccagaatataccacatctctgttttcccatattccttttccacacgcagcgcatactcattgtccgggtgaacctgtatggacagattgccttttgcatcgataaatttgatcagaatcgggaaaaattcaaatgcgtttcctttggtgccaagtgcatcctttcccagcttttccacatactcactcagtgtcagtcccttgtactctccactgtccacaatactctgtccgtccttgtgtgtggataactcccagctctctgccacaatatcaagatcggttttcttgttgtagttttcctttaatttcgttccaccccacaaataatccttaaatgcagggagcagtcttaccaatgccatactaaattacctccaatttcttcagggccttataaatcccctcttcttttacggttccggtgaccatgcttgccactgcgtccagttttggatcatgctttcgcatcgcgacaccgtgcaccacaccagcgagcagctctacatcgttatccccatctccaaacgcgatcgtcgcgtccatgggaatgtgaaaataatcgatgatcgctctggctcctactcccttgtgtatcgtcttctttgcgatgtcaaaggtattgcaattgcggtgataggaacacagatacgttttttccagctctgcgccgcttgtttccagctgttttcgatttgggaatgtcagtgtgatttttccaatcctgcccctgacatcctcaaagctgcggtatttgacgaagttatcttccggtatcttaaaattatccataaaatgcagatattccgactctttcagatcctttacataacagaatttcgttccctccagtatataattgatagataagctatccatatactgaagcagagacagcagttcctcatcagaaaaaacatcgttgtggattaccttaccatgcacagttacatgcgcaccattgcttgtcacataaccatccagatgcagatccttcgctccgtttggaatatagctcaatgctcttccggttgccagcacacacaggtatcccaaatcctgcagacggctgatcgcagcttttgtcaactgcgtaggaacatagatttcatctctttcatctaccagcgttccgtcataatcgtacaatacgagtccttttaccataatcatcctccgtacagtttaattataggagaaacaggttaggattgcaaacaggaatctcgacatttctgaaagaagaggggtttgtttgaggggaaacatgatgatcgcaggacatgttgtaaactatgttatatgaatgctttgtgtatgaaaacattcgaatctgttttccttacattgtgactgttgcataagacttaatggatttcgtattctagactgtccctcgtgaatttactagacattataaaaaaatcccttacaataaaggttgaatagctgggaggatttatatgaacataaaagcagtattttttgacattgacggtaccttttacgaccatacgaccaatcgtgtgctgccatccacaaaggaagcagtacgaaagctgaaggaacagggcatcaaggtcgccctatgcagtggaagacccctgcagctggcagctgaattaccggtattcgatgaattctgctgggatggattcatcggtgggagcggtattagtgtgtatgatgaaaacagagagctgatttgggaaaatgcatttacagaagaccagctgaaaaagctgtttgcgatagcagagaagcacgagctccccttgtatgtgaatggggagaaaacctttctgacaagaccactgcctgccaagaaagaatttgttctggatctgtttcatttgggcgtaccggaaatacgaagctggaatcatgaacgcgtggatgtgctgagcatttttgaaaaccgtgattatgacttccgtatgtttcaaacggtggaaaacatcagaatgcagccgtcctgtgactacatcatggatattttgaaaaaagatacctgcaaggcgaccggcatcaaacagctgatggcttactgggggctggaaaatgaagcatatatggcgtttggtgacagtatgaatgactgtgaaatgctgcaggaggctgccgttggtgttgccatggggaatgccatggatgccgtaaaggcctatgccgatcatatctgcggcagcagcgatacacctgctatccatgacaccctgcaggcttacggactcattcactaaaacaggaggcacaggctatgaaaataaacgctgtattttttgatatcgacggtacatttttcgatcatgtgagcggtatggtgcttccggaaacactgacagccgtaaaaaagctaagagaaaacggctataaggtctgtttgtgcagcggccgtgccaaggaaatggcagagcagctgggtgttttacaaatgactgcatgggatggctatgtcggcggtgccggagtaagtgtctacaacgaacgtatggagctgatcagcgagcatgcctttaccagagaacagacggcacgtatatttgagcttggcaggcagtatgatatctgtattcagtcgcatggaacgtatgaattcatgacgaagccgctgaatccgtatgcccggcaaacctttgcggaatttcactgcaaggttcccgaggtacgggactggcacgatgagcctctggtcgccatcagcgcatatgagaaaaaaagctttgactggagtatgttcgatgaaattgaaggtattgagctgcagcatcccaatgacacctgcgtagacttcatgcaatgcggcatcaataaagcgaccgggattcgggagctgatggacttctggggttttccacatgattcctacatggcgttcggtgattctttgaacgatatggaaatgatacaggaggcagcgtatggcattgttatgggaaatggaaaggatgccttgaagccgtatgccgatctggtcatcggacccagcagcgaagcggtcatttatcagatcctgaaggagcttcacatgattgattaggatgagggaactgtattttcaattctacaatgcggatagaaaatctgtattcaaagacaatatatgaagaaaatcagagctgtcaatgaaggctctgatttttgttttttatcaaagagagagacatctgttacagggtctgcatatacgtggtaaagccaaggatcagcacattgaagaatccatggagtatagcaaatcgtgtaaatagagaaatgatccggcagcttgataataagtgctgtaaacactcctccaatcaggaagctggtaatcagctgcagcctgcagaaaagtaacgatatggaaagcattttccctattgaatacaggtctttttcatgcaggattcaaatacttccatcctgctgcaaatagcggcggatgtcctgaatctgccgtctggtgtcataataccccatccagtacagactgcccagcttctccaaatccggctccagtcttcccactgtaaccggctgtgaaggtgcgatgacatagacacgtttttgctcctgcagaatttccagcgcctcgcattgccgattataattggcatccatttcctccagcgctttcataaatttcgggtacggtctgtagatcgtctttcccaatggcagctttcgggtgatactgtccgttttcttacgataggacagcggtcgcgtccgcacgacgataatttttttatagccctcccgcaaagcccagtcaaagggaattttatcactgcagcctccgtccagatacggatagccctccatccataccattttggaaataaacggcatagaggctgatgcctgcaccgcctgaaagatatcgcggcagtgatccttttcaaaatatgccggctctgctgtttcacagttggtcgcaacagcaataaagcggcggtcaaattgaaaaaaacgtttcttatcaaacgggtattcctgatctgcctgatgaaaggcaaatgcaaagccaatcagaccttccccgttttgcagtgcttttcttcccacataccgcttgtcatggcggtatttcaaattcatgcggattgatctgccaatctgaccggatacgtaattcaatccattcatggctcctgcggatacaccgatcgtacagcgcagattgatgttttccagcatgagagcatccaacacgccctcaccatacagtccgcgaaatgcaccgccctccagaacaatgcagccttcctgtaccattgtggatgcattcccgtgcggcagctgatgaaagccggaatatattttgttcattccatcacctctcacattccaataatgaagcaactgcgtatcatggcattggcacggctcatggttacagtcattcattcgttggaattttacgtaagcaatactagcacaactctatcccatagtcaaacgataggaaatgaaaaaccgaaagcatcatcaccttcggttcatttctaaaataaatatcaaacagagagcttacaaagctgccttgtttaatcggaatacggacacgaacatttcatcatacaggagaatatgctctcccattcttcctgcgctgaccacctcatcacgcagaatgcgaagccccggctttactctgatcatcaactctgtaatttcctcaatggtcttctgttttttgctgtgaaaaaccagctcttctcttccgatttccagaaaagcctgatatagttcttccggataatcgccaagccaaacatttggatagtgcatgagcatatgccatgcatcatcaatcttgatttcttcttccatatctcactctccttgctatattgtattatagagtagagaaaatatacagaagaaggctaaggtaaattctggaatatgcttatatactttgtcgcgcatttctcataaatataattctgtacagccgttacttatgtgtacagaattaggaataaattaaataaatgcaattttaatgggataagctcacagttctgccgctgtccctgggataatacatgcgtcacatggttacccgttatatccctagataatgcaagatagcttacagcttttacattcatggaccagtgcttgtttcatattgaaatagatactctttatgtttactacctgtgtatgccgctactggtccattatatcttatatacaattcttcaccttaatactaatatccctgctttgatggtttcaacctgcatccgcaagtaccacagacttttttaattcctgttaagcatttaaacggggagctcattcaattcatacgcataattcagcttatcttttgtcctggatgagccttgattcttatatcgtccataaatatagcttctgatttttaaaattcaagggagatattcgtcattatttagccttaattttatgaaatacagcctatacgataccaaagaatgctaatgcgatacttaatgcaaatacactaagtagaatcgttgttgtttttattttctttcccaataagaagtacataataccgaacattgccaaaggtaataagcctggcataatctgatcaagataagtctgaagcggctgtgcaaatttaccactacctaccattattggaagttgaaagcttaccagtgaagctgtcatacatccgataaccatcagacctacagcagaagcaatataagtaacattatccatgatacctgaattcaaaaactgtttaaagaaattagtacctaactcatatcctttaaacaagcatatatatcttaaaggaatggttggtatattaacgattagaaggaataataatggacccagaatactgccattagcagagaaagaaatagcaatacctgcagcgatgatacgtaaggtaccccagatcaaagaatcaccgatacctgctataggacccatcaaggaggctcgaacagcactgatcgaggtttcatcaaagtcagggttatttgcattttcttcttccatggctgttagaattccatataataatgttgataaatgtggagtaatcgccataaattccacatgtctctgtaatgcgcgggcacgtttttccggatcatccgcatacagtttccctacaactcttgacatcgtataggcagaccctaagttttgctgtcgctcaaaattccagacagcatcctgtctccaagacctccagaaaactcccatcaaatcttttcgatctaattttttaacatcactagaattcgttttcatcacttaatacctcctctgaaatcttattattatttgtttgtttaatcgtcaaaataacacctacaataacacatgccatcaatgctacgccgaataccggtatttccagatatgccgataacaggaagccaccaaagaagaaagcagcgacatctttactgataatcattctaactaacatggcgaacccgattgcaggaataatgcccgtagcaatctccaatccatgatttatgaatggcggaatagcagccacgatatctttaattaacggagcacctaagtagtaagaaacagctataattgcagataaggaaacaatttcaaaaatccatccaatcgtctctgttctttcaacaccgcgagcatctcctgcagcagcacatttatctgcatgaccacagaatacaggggaagtaataagcactctgagtccagttttaatcatcagtaccaaagtagcaaccggcactgctaaagccaccgcagcacttggttctccaccactgttaataacgaagcttgtcccaataatagcacctgataccatttccggaggacagcttgctcctaccgggaatgctcccaaccagataagctccaaggtagctcctgtcatgattccagttctgatatcccccaaaaccaaaccaactagcggagccataacgatcggcctgttccacatggtactgcccactccatcatgagcgaagccaaaagcagctaccaatgtaatcaataatgtttgtactaataaatccatcttttcttaccctttcctttcattaaataagtgtcattacatcttgctttgaatcatccggaaccatacgaacttccaactcaatacctttatcattcagttttttcagcaattcaatctcttcatcattgacagaaagtgctttggaaatctgacgttttcctgcttcatttttaatgccgcccagattgattgaagtaattttgtcataaccaaaagctaatctggatacatcttcaatgttttcacaaagtatcattagattatatttgtctgtaactccggcatttaaagctttgatagagtcatctatgcttttcatgaccaatttcacgccattaggctttgacaatcttaaagctgtcattcttaattcatctttaacaacagcatcactggcaattaaaatgcagtcagtactgatactttttgtccaggtaaacacaacctgtccatgtaataatctatggtctacacgaactaatacaatcatatcttattctccctttactaaagcatctcttacagcaatcaatttctgtacattcttttcatcgacagttcctgtcgcaatatgagtatctttgacccagcttccaacaataccgccatctgctactgcaaattgcttggtacagttttcagctgtcaagccggcacctacgattaacgggaaatcgccgataatatctctgaattcctgaatttttttcatgctggtttcctgaccggtttcatcctgtgaaaccgcaattgcatcacagcgtgtcatagcagttttcaaatcttcttccaggctttttccggataagtatggtgtatgtttaaaacgaacaccgccgatgatatatccggaatatcttgaacgatatagtttgatgaattctgcaaagctgatgtcttcacgctcaattaaattacctgcaatagcgtcaatctgcacaaagtgtgcttcatatttaatagctaattcaaatgtcaaagtgttctggtataagcaattaactccataaatgtgatctttatagttttcctgaagatattctaaaaccggaatcatatgatgataggttccaaaatagttttctactaataccgcatcagcaccattgttgtaatacgtatcgatttcctgcttagctatttcaaatacttcttcatctgtatttcctttaagatgtaacattccgataataggttttttccaattaaaagcttctaaaaaatttttattcattttatttgtcctccttttaaagttcttttatgttgctacatgtgttattacagaataataagtttaacatcctttacaatgatatttaggcaactatcttgtaaagcttcacaattatcccgtagccagaaattcttttttcatgtctctctctccttcctttcctaaaaatcttcttcttcctgtttatctatgctctttctacaggtgattcctgttttagcctcatccataatatgtgccatacgcttctcactgacatcatcatgatcgctcagcaatacactcagcaccagattcaaattcatacccgacagaaccgttacatcgccaaaggctgtcagctgcgataaagccgtatgcacactgcctcccagaatatcagccagtatgatccatgcatccctgctgttttctatcttcaaacgaagctgatctgcataatcctgcggattctgacccggatacaggcagaacacttccacaccctttgtaagatcaccaatgatcatggatgcggaatgcagcataccctttgccagctcaccatgtgatgccagaattatgtttgccatatctctcatctcccttcactttcttacgtagcaaaaagcgtgccaacttagcctgctccatataaaaaaacaaaataactgctgctttctgcaatttttctttccaatctcccctataagctctctcaatatgattctttttgtgagctatagcacatgagtttcttttcaaaatgtatatgtatcgacgctatcccgctttttatcgacgctaatccaacagggaagtgctgttatataaaaaaactccatcatgcacacactttccaccccggatactgcaaacgctcgataccgatcgtgcatgtgagtaccgtctatgcttctgtgaaatatgcacataagcagcttctcctacatttcattatttataaatcgaaagccgtcgtataaagagtgctttttatgtcatgctttcctgtattatcaggctactatgcgctctggctttcgaatatcatcctatatataaaatgaaagcctttaacacagggtattcctcccgatataaaggctttcaataaccgtcatcatgttccacataattgaatatatacccgatttcctcaaccggaatttccacaccgtaatactcctccacgacactgaatgcatgcttcacacactgaatgaaggcagcttcctgctgtgcaaaatcctcgatatctgtaaaaatatcaatttctcttcttgtcactaggcgttcaatcagacagcatatatgcacatacagtccgaagcaggtattgttggtaaagcgcagtcccagctccagctgcagcttgtcaatcgcatccgcaacatgctccagaagcttgtttggattgagaatcgtcagattgttcataatatttgacaaagaaaaattcttcagtatgttttgctggaaggtcttcatctcctcctcccgcatatagtcccggaaatagatgttcaatgcatccattgtatcattgataatcaggtcctcgatcggaatgaaacggattccctcaatattgggattcagcgtgcctacaatgcagataacctcatacgtgtcgaaaaaggcgtcgtgcatctgcttctccagcaaagtattataatcataggtcaaaacctgaatcggaaagttatgcggcagggaatccgtcagaattgttttcagcttctctgccgtaccgatcccgctggcacaggagcataaaatcacctgctcctttctgcgatgctctacgatatgataatgatatgcactgtaggtctgcacggcatcaaatatctcctgcatgccggttccctgaatcataccgtttccaatctcaagtgccagcttggttgtcacattgttcataataccgatattggcattctgattttctatccccttatacaggtcctccaaagagcccatgtccaccaatagaaacagttcctcaaaacgaccgattttgctaagatatcggttcagacgctcaatgatttcctgtgtcgtgacatgcagcggcatatcgatggaatcaaagacataacgccccagaaatttgttcacggcatccgcaagagaactggcggtggaaaagccatgtgcgatgatgataccgatccgcttgttcaaatcctgcatacgattcagcagcttcaggtgcaggcacaaaatcaccgaaatcatatcctcaaatttcaaatccaggttattttcaagatgctcacggatttcccctgcaatcgcatattctctggcaagcttctgcttcagaaatttctgcagagctgccatctgcttgcggttcgcctcctgccagttgccaagctccagtgtattctgcatacaatccgcaatacatgccgtaatggcgatcaggtcattgttcacatacttgaagccatagcgcagagacagcatatcgaagatattcgaaacaatcccctgaacatactcatttcccgataatgctgcactgcttcgcagcatcgtggtctcctgataggaatgcatcgctttccctgcttcatcaagacagacaggaaactcatgcggtgcctgaaatgccgcaaggatatgctccagcagctgaatgatggggcgctccttcgatacaaagcttttcagttcatgaacaggaatcatacgctgactttctctggacaccgatttcccgctatcctttctttcccgcagcttctccggaagattgaatgcacggatttccagaatactgcttttttgatcggatgcaaataatgcatttacacagcttgcctgtatcgcattctttaattctccgatgtttccttcgcattcacagcttaacagcagacggtatacaagcgatgatatatgaatcgacttatgaatacgcttttcctcatcctgaaatatggaatgaatcagctgcagccgctcgtgagagccgcgctccgcaagggatgggacagtgacaatcattggaatccttcgcagcagtgtttttaaaaggacctcctgcggcttctccgtagtcgcaaatatcagacggacactggatgtataccatttttcattatcgccaaccatatgatagatgcctttatccataaacagaaacagcttttcctggcattccgccttcagacaatgcacctcatccaaaaacagaacaccgccctctgccagcttgatcaaaccgggattatccctgtcagctccggtaaacgccccttttttgtgaccaaacaggttggcagtcagcagctccggattgttcgcatattcactgcagtttacaatcagaaaatttctatcctccgctatcagtccctgatttattgcatactcatacataagctgcgccagaaagctttttccggttcctgtcggtccatacagcagaagtggaagaccggagggcggataggatatcgtcgccttacactgatttaccagcgaagccagactttcatcatagccaatcagcttctcaaaatcctgcggctgatgcggctgcagcgctttttgaaattcctcaagggaaatgaattcacgctgatgcagtgaaacaccatacatatcctctatcgtatccccgtcataaaaaacgaccggtctggtattgattttaagcagacgtccttcggcaaacagctgattgagatactgtgaaaccatattgcggctcagctgcagctgttcactgatatacagcgagttcccctgatcgctcaattcaagctttgtagcctccaccacataggcatataccttttccaacatactgttaccaactccctttccttatgataagtgtatagggcaaagatttgaaagtcaatgtggaaacttatggaaacgtgcaaatgttggcacgctttttgctaggttataaaaaagagtgatagaggtgatgatatgacacaattcctgcagcagaatcagaccatgaagcagacacacatcctgacacacaagaatcagcaggcattaaagattttgaagatggacagccgggaattgctggagctgatttccgaatgtgtacagcagaatccgtttcttgatttccatcccagtgcacagggtgacgattatcttttgcaaaatgcgatacaacgaccgtccttacaggaggatctgtatatgcagctgcacacgctgcgtgagccctatgatgaagctatctgcgcctatctgattgaatcgctggatgaacacggctttttaagcggctctgtttccacatattgtgaggacctgcaaattgatgaggagacattgctgagtcagcttcgcatcctgcagagttttgagccctgtggaattgcggcacgcagtattcgcgaagccctgattctgcaatgcaggaaaacccgtaataccatgggagaacaaatcctttcagaatatgcacaggagcttgctgagggtgatttagcggcaatcgcaggagggatgcagctgagcgtcagggaggtaaaggaggtcattgcttccctgcgcacctgtaatccggatccctgtgcagcgtacgcaaaagaacacgtggagacgatattgccagaggtagaaaactgtgtacaggaccagcagcttcaaatcgtacccatgcgctatggcgctacgcttgtgcaggagcagtatgtgcaggcaatcgaacaaaatgagcagctgaaagcctatttccgtgaggcgaatctgctgtttgaaacactgaatcgcagaaatgccacgctgttactgatcatgaatgagcttgttagcatacagaagcatcattttctgtttggggatgagctgcaatcctgcacgctgcagcaactggcagatcaactcggtctgcatgtttcaaccgtatcacgagccttacagcacaaatactacctttttcacggggaatgctatccaatccgcagcctgctgcgtacagccactgcacagggtgacagcagtgatgcggtacagcgggcaatcacagaaatcctgcgccatgaggatccctcacatccgttctccgatcagcagctcgtcatcaagctgaggacgatggatatcagcgtatcacgcaggaccgtcaccaaatatcgtaagcttctgcatattccaagcagtacacacagaaagcatacataaaaaaagaaaaagcggcaacactttacagcagaggtgtcgctatgaaaaaaacaaatacaggccatgcacaggagcagcctttgaactgctgtgtcatgaccatgggaatcaagcatgcagaacagcttgtgctgctgtttggaaaaacgcgggtgatgcagcttatgaatcagctttctgaacaggcacagcacctgcttcccaaaagagcgcagattgcacagcttttagattaccgtctgctttttctgctgccgtcctatacacgactggatgcgctgcgtctggtatatgatctggatgactgctgtgatgcaatcgcgcagcagctgtatgcggcacggcttgctttatcgttcggcatctgcctgccgtatacctcggataccctggaggatgcaatacagtgtgcggaatactgccgccttcatgatcgggactgcgagcggttttccacatcctatgccttttattccagacaggccaaggaacagctgcatcaccgctaccagctggaacaaaaaattctaaacgccctgcaccgacaggaattcgagctgtttctacagccgaaagtcaatacaaagacccggcaggtcgttggtgcagaggcactgcttcgctggattcataacggcgtctgtatacccctgcaggaatttcttcctgtcgcagatcagaatacctgcatccgactgctggacacctatatgtttgaacgcgtctgtcagcttcttgcacagcgccatgcacagggagagccgctccttcctatcagtattaacgtatccaaagcttcctttgaggacggacactactatcttggagaaatcctcgatatctgtaaacgctatggtgttgatccttccttgctggagctggagctgcatgaggatattccctttgaacataaagagcaggtacagatgtttgtgttgagactgaagggggctggactgcgttgttccctggatgattttggaagctcccgctgcaacctgcatgtcctgagctggatcgatgtggatatggtaaagctggatcattccttttttgccggtccatggaacagccgccagcagatactcttacagcacatcatccctatgctgcacaggcttcacatccccatacttgcggaaggtgtggaaacacaggagcaggtacagtttctcacagacctgcactgcacgctgattcagggcttttattactccccaccggtttctgttcatcaattcttccaagaaaatgaaattatcgagtaattcactgctgaaagcacattctggcaatacgcaataatccaaagaacgaaacggcatcgattcatgctatcacatatacagagttgcacatataagtattggcaatttcacggtttatccatttagacaggaaaaccacagaaatgtaaaaaggaagcacatgtctgccgctaagcgtacagaccctgcttccttttatttaattgaaatgcattcaactcttacttgtcagaatgctgacctgtatgtctccctgcttacagcttgtccagctgttccccgataatcctccaggcggtctcattgtcctttgcaaaggtttcggcattcgcatgaaaattcaccggcatacttcccatatacgccgtaaagccgagacgctgatacatggaaattgctacatagctgttcgtctgtgtcgtcagatacagaggatgctcacaatgcagactgctgtacagctgaatcgttttcagcatcaatgacttcgcaagtccctttctctgatgccgttcatcaacaccaacccagtgcacccgcatacggtgctctccgaaatgatatccctcccagacggaggatgtacctgcaagctgtccgttttcatcaaccaccagaatcatattctgctgaagctcctttggttgagcttcgaaggtttcttcaaaataacgtctgcccgcctccatgctatccagctgaccaagcgatacatgcaatgcaatccaggcctccttataggaaggctcataggggtgaaaggaatacccctgtgccagtgggatatccgtgatcaccggtggctgtgtcaataccatcagcaccggataatagggaatacgcttatctaaggttgtcataggttcctccattctcatacgctgcatgcgtacgattctcgcatgtatagcgttatgcattgactgctttacaaattatcatcccttatcctgaaaaaaggatgcgaagcaatcgcacccttatccaagctcaatagagtaggaataacgctctcccggataataggaaatcgtatactccagaacgttgccttcatgatcataggatacacgttctctaattagcagcggatcgccttttttaatatccagcttctccgcttcttcttttcgggccgttatcgccttgaaattctcacgcgttttcaccggcttgcggatattcagctcatccagcagcgcatacatgctccctgtatatttttcatcctccagcggcagatttctgtctctggaaaaataactgacaaaatacacaatcggcacatcatccccggtccgcacacgatccagccgatacaccagatcaccctttttgcatccaaagatatccgccacatgccggtctgcctttacaagctcgatatgtgcccagcgtgtccccggctgtataccgcgctccagcatttcatttgtgaagcttttgatacctgcaagctgctcttcaattttattttgaaacagaactctggttcccttgccgcgggcacgctcaacgagcccttcactctccagctgtgcgattgcctgacgcgcagtaattctggatacatgaaagatttcctgcagctgtgcttcactcggtaaagaatcaccaggtgcatattcctttgataaaatcttatccttgatgatcttctttatctgtatatataacggaacggctcccttgccaaaatccagcttttccatgaagtcacctccatgtaactattatatcatgtatgcgtatattttaggagttatttcttacgtaagccttcataattccgattttgctgccgacagactctccataaggacgaatcgtatatttaccggtgcttgccggaacaatgaaggtttccgcataatggacaacaaacggttcgaattttccttcttcactttccacaacagcttctcttccttccacaagattcagcatgttgacggtaccggcggtatcatgatgggtgatggtttctgtccagtatcttcttgtttcgatgaattccagctcatgcagacctgtgtgttcttccacatagtcctctgtgcgcttcacctcatgaattgcatttacaaggttttcctcacaccattttgtcgtacggtcccactgaataacctctttaccatgctccacatgtaccggtctcgggcggccatccagaccaacgcgtccccagtcccacagcttgaaggtaaagatatacggagttgcactgatttccagcaccatcgcctcactaccggagcagtggcaggtaccggcaggaatcaggaagtggtcatgcttcttcgcagggaacttattgatgtatttctctgcatcaaattcaatttcccctttgtttgcacggcgtaaatcctcaatcatctgcttttgatccacaccgtccttcagacccagatatacacaggcaccctctccggcatccagcatatagtagctttcatcctgtgtatactgcataccaaactgctttttgatatattctgtcagcggatgtacctgcagactcagattctgtccgcccatggtgtccaggaagtcaaaacggatcgggaattccgcaccgaagcgtgcataaacctgatcaccaagcagcggctttggctgatacagcaccagatccattgccggaatctccacgacagcatctgcaaattccagatacagggagttttcctccggtacaccgtcaaagctccatgcgaaattggatttttcacggtcaagatcacagacctccttcatccactgtccaccccatacacccgggtcgaaatacggaacggtacggaacggctgctgtgcaatctgcttcaatgcaacgcgcagtgcagtaccaggaatcattttcggatcatttgccttattggtatcaatcagccagtcgatatcctcaaacactgacatcttgtgcttatcggcaatccgccattcaatgaagaatccgcgcttattcttacgcagcgggtcttcgtcataattgctgcacttataatttcccatacccgcacgataacgcatctgaatttcccagcgtgccatatcgaaatacaccagcttatcgccaggatgtaccagtgatgctccaaagccgtacacgattacgagaccatcggctttttccacctgctgtttcgcagcctccaacttctccatatcaataaaatcagaaacctctccataatacatcttgccgaatacacggtcatcggttaggatatacttcagctgctctgtaattgttttttcttccttgaatacatcaatcatattgatcagcacggaaggctccagctttttcagctctgtaaggatttcctcatcccgtacccccggatacacatcacatgtgatgacatactttccggatgggatttcctttttcaacgtatccagaatattgttgtagccgacaacagcagcgtgctcatgtcctttgatttttgttgatggaaatttgttgtaattgcttttcatctctagtcctctactttctcaaaacgaagggttccttcttctttatatacgcgatatccaaacggctgacgttcaactgcggcataatcatggcctgcatcacatggccagcaggcaccgattttcatcggctcctcaccggtattgatcagccggtgtgcaagatgtccgtcaatatggtgaagagagccgggataggttttttctgcccaggttgtcccatcctcatccatcagcatcagcaatccttctccggcaatgcagaaataaaattccacacatttccggttttcatgccagtgtccgcgggtcatattgcattcgccgtttaccagtacgggatacaatacagtcagcccccagttcagattgcctgcgcgtttgtcatccccctgtgtatagtgatatacctcatacatcagcgtatcatccgcaagtgcagattctgtacgatagaagcctttcgcatcctgatacagcttgacggaggtgtttacctcactgcctctgattacatcctgaaaatcatgaatgacttttggttcaatgacgttcatttatgaaattcctcccattccttttccttcagctgcggtcttgatacaaacagaaagcgatccgggtcttcaataaactgcgtatagatcggcttgcccggctccagatcaaattgcggatagtcgtgtgcagctatcacgtgcagctttgcatttttgtaggcaggatttatttcccaggtaatattaccagcctctacgaccggaaaataggcaattccatgatgggcacgcacttcctcataatcaaagccgaaatcccgaacacaccatgcaccgaaggtcagcgacttttccacattggcgttgatggtggcatgcacccagcccggtggaacgatgacaacttcccctgctttcgcatggactgcgtaacagtttcccgcatcgtcctttccatattcctgcatatagataaaggcttcaccgtcccatatctcatacacctcgcaggttgaagactggcaggacggggatattgcgtgaatatgcccctgggaacgaaccggttcctttccaagggttccctttgcataggtcacagcaccatacagcagattgcgttctgtaatcgctgtgtgatcctgctttcttcctacatccataacaatgctgtaaagaatttcaggacctgtacaggatggatcctgcagggaggagcggattgcttccagcgttcttttttccggcttcggaccaaacacgtccggtccatagacaaattccatatccttctctctgctttcgatatcaaagccaggatagaattccatataaccacctcctagttgttatatcattatgtcatttacacctgtattgtatcctgtttcccttcttctgtcaaccgctaaaaagaaaaaaagcaggcaaaatttgcatccctttgcatactgctcacaattcatctgaaaagaaaaaaccgtcacctgaatgacagttaattctctctgcgaatcaatcgcatcttaaacttattacgatctccgcggtactccgcaatcgaatattccactggctcatcctgctgtgtataggcaaccgtttccacatgcatcaggacgccgtcctcctccatattcagaatcgtacgctcccgctgacccgcttttcttgcctctacagtacgatcgacataggcaacctcagtctgatatttctgtgagaagatatcatataaggaagactgttcgaaatcctccagctcgatatccaaaaagtgctcatacggtacaaaggtattgaccagaaccatctcctcatgatctgcataacgaaggcgctggaggtgaaatacccgtttgcttttcggataaatctccacacactcctccggcagctcaatcacctcactgacgatcactctggtggatggggtcagatgaagactgcgcatttcctcatcaaagcttcccagcttctgaaagaagtagccttcaattttcggacgtgacacaaaggtcccctttgctttatgccgtgtgatgtagccttcattgatcagttcggaaaaggcctgccgcacagttggacgcgaaatatccagcagctcacagaactccgcttcggtcggcagcttgtccccggcctgaaaaatcccctgcttcagcagctccaccagctgtgtcttcagctgaaaatataagggcaccggtgatgccttactgattgtaaactgttttgcgattcgctcatccataattgtccgactccttttcacaatatcttaattataacggattgacttctgtttgacaacttaagttcgtaatgttataatgtaattacattaaaggagggtattatatggatatcatcaatacactaacagaaaaatcactcgccaaatatttcgatcacacctttttaaaggcatatgcgacaagagcagactttgaaaagctatgtaaggaagctagggagctgggtactgcaatggtcgcaatcaactccgcacaggtacgcgtttgcaaagagctgctgaagggatgcgatgtgcatgtgggtgctgcaatttccttcccgctgggacagactgttttggaaatcaaggtggaggaaacaaaaaaagcaatacaggatggatctgatgaaattgattatgtcatcaatatcggtgaagcaaagatgggacactgggactatattgaagaggaaatgcgtcagattacagaaatctgtcgtgcgcataaggttatcagtaaggtcatctttgaaaactgctatctggaaaaggaagaaattaaaaagctggcggaaatcgcaaaaaaggtgaagccggattatatcaaaacaagtacaggctttggaaccggcggagctacgctggaggatgttcgtttgatgaaggaaacagtcggggatgatgtaaaggtcaaggctgccggaggtgtgcgtgactgggaaacctgcaaggctatgattgaggcaggtgctgaacgaatcggtaccagcagctccattgctattctggaaggcttccgaaacgaaagaggtcagcagaaatgaaaacaatggtgattacaggaggtaacggatttatcgcatctctggtaaaagaggctatgcaaagcaccatggagatcatcccacttacaagaaaagagctggatttaggggaaactgctgctgttcgcagctggtttaacacccatgattacgattatgtttttcataccggagctatggcacagacagcggactgtgaaaatcatccggagctgacacaccgcatcaatgtggacggtacgaaggaaatcgccaaggcctgtaaagagaagaatgcccgcttgatttttatcagtaccgagcaatgcttcaatggcaaaactgaggagggaccgttcacagaggatacaccgttatgctcggttacggcatacggcaatcacaaggcggaatgcgaagcctttataacctccgtgctggaggactacatcatactgcgcttttcctggatgcttggcatgagtcgtccgggaatcaaggcatcaccgaacattattcgtaacgttatgaatgccatgttctatcagacacctgctaaatttacggtgaacgagattcgaggaatgacgtatgcacaaaagctggcggatgtatttgataaaattatcgagctgccttccggtatctatcatgtatccgataccaacacgcataacacctatgagtccgctaaaatcgtagcacagaagctgggattcacacaggaacagatcgatgcctgcatccttccgaatcatgagcggtatgcagatcgcttccgggattatcgtctggatactcaaaagctgaaagcacatggaattgattttggtacctttgaagaaaatgtggatgcctgtctgaaggatttcggctggctgaaataacacgaaaaagaatatcctgtttttgttgacaggatattttttatcagcatacatagaaatataatccgtcaaatcagaatataccaaagagtgcacttacgaaccgcataggtaatcttatcagattgcctttttttccatacgatcaaagcgttgattccataatccccttcacactctttaggcggaaataaatagataacattttttctataaaccagcttgatgtctatatatagatactatattatccgttttcatatgatctaattcaacctaataaaatcaatagatcagcattttcccttccgaatttaaacagctttatgcttaattacagcaaatcactgcctgctataccttttcttcctaccttccagtttctaatgacgattatcactacaattttcatctgaaaatgatataatagactggtagtatatggaggaatgattatgaaaatagcatatctgatgcattcagaccggaaatacgatgaggttgtagaaacgatcaatcagcttaccaaacaaggggatcacgtttttatcatgataaatgatgatgatctcagagagcaggttcaatttgtgtacatggattattccagagtacatatttcccacacacaggaattcgctcaggaaggcgatatgtcaatggcaaggggtacactgattcaaatgaaggaagctgttcagataggctttgattattatatcaatttgaatgatggtatgatgccgataaaaacgagggaggaaattaccgcatttctggaagaacagaatggtaaggatttctattatgtggaaacatctgagaaagaggagcctgcgctgcgtaaaaagactttaaagtattatcccttcacaaatcttctggcctttcccagaggaaaagcgacacgtgctattaccagaggctttggaagcttactgtatgctttgcacatccgcagaactctggatgatgtcattcaaattggcagtccctggtttatgctgacgcataccagtgcacagatccttgcagataattttgactattgctccacgacattcaaattatcctggtatgccgaggaaatgtatatccctatgatgctggataagtttggaaataaatgtgttgagcatgtaaataatgattatcgtgttgtaggaaacggaaaatgggaacgcagtcaaaacacacgcacaacaacacaggaggcgattgaccgatatccggaggcactgtttgcgggtgctattctcgtagatgaagatttcactctatatgaaaaatatttcgatatatataatgctaatttagaaacggaagaataactgatcatcggttattcttttttttcttagcttaactgttaaaaaagttaattattccatttttctgctaaaaatgcaataatcaacacaaattctaattaataatctataattagtttagaaggagggtaatggaaaggagggaagtaatctcattattatattctcataatcctctgtttcgttcaatggcatatatcaagtgaggtgagaaaaatgaaaaagatttttagaatttttacactagcatgcttcttagttttattaaatttagcctttgtaccagcaactcatgcctttacagatgatgttagagataatgagaaaattatcactgtatttgcgaatttggataatcaaattgaggttaatagtgtagttcaaaatgcatttgattcatataatgctgatattgtaagggttctagatatcagaaatcaatataatctattagctgctgatgaaggatgggtaacaaatagtgcccaatattattatggcgatatgattcatgggtcaaaaggaactataaaatgctatgttgtacaaacatctaagccctcagtttcttcatgtagtggttctgtatatgtagctggcaatggtgtgaaatttgtctctaaatcgataagcaataataattcattaagcgccagattaaactggactattcgcttagaggcttcaagtggatccattccgactaccaaatcacattctgtaggtctttacagctaaggttatgatttaaacactcgaatataatattaacccattctggaaaaaaaagccatggcaactttgtaaaatcgtgtcatagctttttttgtttactaatatatttattgtttatataaaactatacaaacaaactctatatttacttatcttaaatcaatacgttttttaaaaccctttcaattcatcaatcattgctaaaacatgcttcttcccattacggaagctcatgaaggacataatggtgaatccaccagatagaattgcaccaaccagagcaatccatttaactacatttcggactgtatcactgatatccggtaaaataggatctttcatgccggtaaatccccagacacaaaggcctgcagtcacaaggaaaataatccctccaaccttgacccagcttccgagccgtcgtaccagtatattttcagactgtattttctgtttcaatgcatccttctctgatttcttcatcacttatacctcctgttataaagaaatcatccccacttgggaggcagggatgatatttctatttttttgttgattagtaagacagatttggatcgaagaatccaacaagaacaccgacgatagctacaacaaccatcagtagcataattttgattggactaattgctttcttagccattaaccaccagcagcccagtacgaacagcagagtcaatacgccagggaatgcgccatccagtttttcctgcagtaatacaggtacttcctgagttcctgtaaccttttcgattactttggaaccttcaataaccatttctgttttattctgaatagaagttgtcagctgtacagaagtagtaatagatacccaagtaccagccatagcaccaacgattacctgacccataacgattacggattcacgtaatgcagttgcctgctcaccaacgataacttctacagcagaaccaccaagttcataacctttgttatagatccatttctggaagaagatactagtcacgttccatacaacgatatagaacagaggaccaataatggatccgccttccgcaagacctaatgcaatacctaataaaactggaatatacgtaccaacgatcagagagtcaccgataccagccagaggacccatcagacctgcacgaataccattgatcatttcatcatcgatttcttcagcaccgtttgcacgagcttcttcaagaccagcggtaataccaactacgatagaaccaatctgaggctctgtgttgaagaatggataatatgtctgcagcttttcagcctgttcatcttttgtttcatataattcctggataattggtaacatggaccacatgtaaccgaatgtctgcatgtgctcatgagagaagcaagtcaggttaccatagaaccaacgccagaaagaactatttaatgactttttcgatacctttttcataattaaatgtcctcctcatcatcgtcaattcctgcaggacctgctgcagctctgtttctaatcattgtcatctggtagttaatcaatgcaaatacagcaccaactgcagttgcagcgatcagtgtcaggtgcatagaacctgccagtgtgaaaccaaataagaagaagatcaggtcagttgccttgtttacaacggatttcagcaggattgcgattccgactgcaggcagcaagctacctaatgtaaacagggatttcatataccaggaacccataggcagtgcttccttgaactggtcaacagcatctgcaccataataaacaatcagcataactgggatgaaggaaatcagtaagtgagagataagagggaaaataacttcaaccttaccgacaatactgaaatctttcttgtccagacgagcccatccaatgtgctgccaaacaaggttcatcatcgcagttccgtagaactgtacagtacctacagtaccaaccatagcacctaaagcacctgcaagaccgcttgcttcagaaccaccaaggtcaagaccctgagattttgcaagagcccaagccagagggataccaatgtaagaaacggcacgtaaatccgctgctacggtaccacctggagttaccagcgcgatataaataatctgcatagggactgcaatctgaatacatcccttaacgtcaccaaggatcaaccctacaaatacggatgcgatcaatggtctgttcaatgtgtagttaccaactgtagtacctaaacatgcaattgtggaggccgcacaacaactcataagaccgagtaaagcagcctgtacccaagaaatcataaattcatctccttttcctttttgaatttatctaatctaattcgaacacaaatctcccaatttattagtatccgaatttagatctgaattttggccaggaaccgatagcagtttcttccagcagtgcaaagaatacatcgtaaccagcgtttgtcatcgcttcgcatgcttctgcttcttcctgtgtgatggactggttctgtcccagcttggtagcgcccggacggtcgttgcaaggtccgataacaacacgttttacatcacttggtacaaacttgttgtcaaccagcagctctttcatgtcaaccggattcttcgtaatcaggaagtatcgcttgttgctgtcaagcaccgtctgtgccttctcaaggaagtgttcctttgtccatacaaatacttttttgtccgtggatgctacgaatgactgtttcagaacaggtgtggtagcagccttgtcgtttactgcgataataccgtcacaaggatattccttggaccagcgtgtgatgatctgaccgtgaatgatacgatcgtcaactcgtacaaaactaatcatgatttatgtcctccttagattaaattccgatgtttaaatatcgtcttccgcgtcatcgctctctaccttgaattcggtaagaccggcatgaccctcgctcagcagcgtttctttcaacagctctgcatcgtcaaaattatctttcatcaatacggcggtgattgccagcggcatattcatacctgcaatcactaatgtgtttggcatcaggcctttttcatcaagaacagccagtgcgttggtgaatggagatccactcagaatgtctgccagcagaataacactgtcgtctgcattcagcggctcaaccagtgttctgaagttagctgcaaattcatcagcactcatatctgccttcagacttgtactcaggacatcgtcacgttcccctgtcatcattttgacagcggaatgcaatcccggtgcaaattcaccatgacttaccataatcacgtatttcatttgtcgtcctcctttttttcacggacacagaacaaaactacggtgtgaaaggccaaaaaaatattttggcttccctaccaaatcctttttcttacctgccttatgcatttacctatacttaacagtacagatgataatcgtggaaaatcatctgtttttttatgcttttgcatagaaaacagggatttttcagcatgtctcataaggtatacgttttgaaacaccagaccataccagctctgtctgtgttatggcagctttcacatttcgaagtgaccagctttcgttgaaatgtaatcgcttacctccgctatttacattgtaatcttacaccacgttcctcgtaatttcaactgttttgataaatttttctcacataattacaaatgtaatcacacattttaaccaaaatgtcctatctgaaatagaaaaaaacgcatatttacagctatttttagcagtatacacgtttttatgtgaatattgtgtgaaaaatttatcttacaaaacttaccagaatacgtgccttcccacagatttcaatgtccgcacagcccgccggtacgaaaatattctcagtaaatgcaaatggaagctcttctccctgatagcgaaggacacagtctgcggaaacattgctcagacagtaaaagcgcttttcatcctgcggcagcacgtagcttcccgcaacatccaccaggcgcacactgaattcccgccggtcaaccagcagcttctcctgtgtggtatccgcatccgtaaaaggtgttgccactttattacagtgcagtccgaaatctgcgacatcaaagcttttatcgatatgcagctctcgctccctgccattcgcatcctgacgatgataatcataaaaccgataggtcgtattggaattctgtccaatctcgagtgcgagaatgccttttcccagtgcatgcagcataccggcatcaatgcatacgaaatcaccggcctccacctcgaccttgcgcacataatcctccacctgatcattttcgacagcagctttgatcaccgctgcatccgacgcagtcgttccggccaccagcgtagctcccttatctgcttccagaatataccaggattctgttttcccttcatcgttttcatgcgctcttgcatattcgtcatacggatgtacctgaatggataaatcctctctggcgtccagatatgcaaggcgaagcatctgatgcagctgtttttctcccagtatagattgcggattcgcctgaatcacctcatccagcgttttccctgcatattctccattcaagataacattttttgcatatggatgggcactgatctcccagcaggtgcccatccctttttcttccataccgcgcatggttgtcagacggtcgtttgcccatattgttttgtcatatataggctttaacttcataggatacatacgatctacctcttttcttattcctttttcaaacagattatacaatggaacctatcaaaaatcaacaaattgtaattacattataacattttttaagaatttatttgaagccgattgcaagtatattgttataatgttataatattgtcagagaggtgagcttatgtacacatctgtaattactgaccagattgatgaagatctggaaaccgccttacgtatagccaagctttatggttatacgcacatagagctgcataatgtatttgggaaaagtattgaagagtgcagcctaaaggaaatcaacaccattcgcaccttgctggatacctatgaactcaaggtttcctgtatcgccagtaccgtcttctttctgtgtccgctgatggagaacgataaagtaagtctgtttaatccggcatttcatgcgattgaaggggatgtccctacacatcttcgctatttgaaaaatgcatgccgcattgctaaaaagctgaactgtccaagggtacgcatctttcctttccgctttccggataaccggccgcctgcctatggcacacaggagcatatcgctctgattatgaaaaatgtccggcaggctgtgcagattgcggaggaggagcatgtgacgctggtgctggaaaactgtccgtattcccaccttcctaagggtcatatgagcattcagatcgtgaaggccataaaaagtgactatctcaagctgctatgggatccggcaaacagctaccgtgcctataaggaaaatgtccctgcggagtatctgaccttttcactcgaggaggagctgcattatatctatccttggatcgatcacatccatattaaggattatgcatacaatgccgcactggaaaagccgtttcagcatgttgccttcgacatgggagatatcgacttcatgatgattttttccaatctgcgaaaatacggatatgagaatgccgtatcgctggaagcagaaaccgattataatgaaacactcaagagtatgaaacgcatgcaggactgggttacattgtccgataatacctgatgcctaaaaaaacctgttttccttacgcagagcaagctgccttgaggaacaggttttttataagaaatatttaagtatacaaaagcgcagataaaacccgcccttttcagaagcgggttacttttatcatcaactcatcagcatctgaatgcctaagaaaataagcaggattatgataggaagccccagcagaatgacataggcgaaattcaccttatgcacgaccttgttccagtttttctctacgaaataataccggtcatcatcggttttcataatgacatcggtttccatcagattggcgatggtgtatgcaatcaccgaggtggacagtcgaagatttttaaatgcatcgtatccaacggccgtatccggtgtgaacgcgtaatgctttttcagaacatccataaccatcctcgccgatgtctgtcctgttgttgtttttttcttagccataaaaacactcctttaagttatttactatgttgtttgtactctattctataacaaaagtcacagcttctgcaacactttttacaacatgtgcagcttccctgcgcacttcctgtgctgccgaagccatacagaagctggcttccacctcatgaaacagtggaatatcgttggcaccatccccgatgaatgcgacctcctcctgtgacagcttccaatactccagtgcctgtaaaaaggattttcccttatcgattcccttacgggtgatttcgatgtaatcaaaggatgtcggcaggatttcataggcatcctgaaattgcctgcgcagaatcggcagccaggtatcccggcgttcctgtgtatacgtatggatactgattttcaccaccggctcctgcttctccttcaaatatcgcaacagatcccgatcagcaatatcaccgaggtaggcaagctgctctcttacctcgttccagtgctccggtgcatactgctccctcataaagaagaaggtgctttgctcattgcagacaaagggattgatctcatccacatgatcctttaaaaactccataatgcgtactgcatccccggcttcaatgtgctcctccatgaccttcttatcatgaatccagatagatccaccgttatttccgataatcatatccacagcaagtctataacggctaatcaacttctgacagaagccgtaatcccgcccggttacaataccaaaagcaatgccgcgctctgccagcgtatgaatcgcctgcacatcctgctgttgtatgttgccatgtacatcgatcagcgttccatccagatcactcagaaacagcttcatcatcacacaccctgtcaatcaatccataatgtaaaagtgcctgtgcaattccgtttctgctgcacagcccgctcacataatccgctgcttccttcacagcctctctggcatcccccatcgcaacgccgatgccacatgcttttatcatttccagatcgttgtaatcatccccgaagctgatcacatcctgcatgctccagcccatcgcttcacatatatgcgatacgcccgttgccttgtcatgggcaccgttgatatcgtaaaagcaggtatcaaacggtgtaaacaaaaactgcgggaagcgctgtttcatcatttccagatcagcatcctctattttagcgacagctgccaggggcatggtatcctgcagatagccctcggattcccgctcatccaccagaatatccagtcgtcccagaaaattctgcagcatattggcaatccgcttatagccgtgatagcagtgtgccgcatcctgacactgaaacatcaatgcattatccgtctttttaaaggcatggatcagacttcgtgtttcctccatggaaaagctgtaatgatagagcacctcatgctgtgcattgcgcacaaatgcgccgttgctgcagacgaagtaatcaaagctcacctgctccagcagactctgttccatagcaaaaggaggtctgccactggcgattgccaacttcactcccttccttgacagctcattcagagcatggacacacgatgcaggaaccctgcggttccctttcgttaccagagtaccgtcaacatcaaataccgctagtttaatcatagcttcctcctccagatttctttatttatttttattcttcttgcgtttcttccattccagaaagcattcatgcagatagacacccatctttttggataccacaacatgctggcgctccgttgtcagaatatcaatatttttgataatggatttcataggatccattgacagaatggagcgaaagcgataatgcgctttttcatatacaaagccgtcatcatccacgattgcccgccgcttcacgatggaatccagtgccattcccgcacagataatcgccatcaatgcgagcgcaaagcagacatacaactcatcctttgtattcttttccatcacaaagataccaatgatgccaatgacagaaaagcccaggaaaaaaatcatatacggcagatactgattcaccatggtatagccgtccttatgcttcttcagatattcctttctcaccttctgattggcaagaaacaggcgcacattctgtacggtcagataaattccgtagcacagaactgcggcacagataatataatccattgtatcaaatttactcatatgaactctcctcacatttctaattcgtattatacactattttttcacagaaattaaggagcaggtgataaccggttacatttgttaatccagacgtttgtataaaataccaagtcccagcggtacaaatccactcagaccgatcagcgccagtgtcaaatcggcacccagggaggataccatcgctccggcaatcaccggggtgatcagcagggaaagtcccacataaaaggcagaagcgatcgtctgcccgctgcttcgcagatgaatcggtgttgtatcatccaccagtgttttgctggtaatcatgatcagcggataggtaatacactgcatcagcgtcaccacgatcatcatttccggactctgtacaacggcatagcccagaaagcggatgatatacataaaggtaccaaacatcatcagcttataatcaccgaatttcttcaacagccaggttcccgcaaaaaacagcggcagctcggtaaaggcctgaatgctccatctggcaccgaccatgccctcctttgcgcccagcgccatcattttatccaccgtcgtgtagatatccgcagtcgctatcacattgataaacagaaaaatcagaaccacgacaacatatttcttatccagcagcagctcctttaaatccgttgcatgaatcccgccgcttttttccaccttgaccgcatcctgcatgaacattgtcagtacgatgtttaaaaccgcaagacccgcaaacacataccccagagccggatagccgtaatgctcgacaaccagagcaccgattggactgccaatcatccagccaatcgccccgaacgcacgtatcgggccaaaattattgcggcaggtttcacttgtctccaatgtccaggtatcctgtacagccagcgtggtacgaaacataccgcctaccagagatataaaaatcagatgcagaaagaaattccgctgtgtcacctgatacatcaccagcgtggatagcacaaagacaatcagacagaggttaaagaatttcttatccgttttgtacttatcgcataaataaccgataaaaaactgcgtgataatagccacaacagccgtcccggacaaaatgataccgcgctctacaacatcatagccgacatattccagaaaggtctgcatatagccgtaaggcaatacgaaagcgatataagacagaaagtagaacaggcacagcatggccacgtttttcttttgacttcgcatagttattctcccttttatagaaaaggaccggcgaatctgcatccgccagcccgcattgatggcgttttcccatcagatattttcttatcctgtacccgcgtcttgcgacggacgacagccgaagcgctttggaatggtcagttccctgtacaggctttcacgattatccgtttgttgaattattccatattggcatgtcttccaaacatcgtatcggaatccttgcctcttcgctccatcagcatcataacagcaatatccatgaagattccctcgctttgttcaaacagagatcccattggctgaatggatttgatatccccctgctttgcacttttcggtgaaggtgcgctgatttcgataacgacatccgccataccggcgatgctggagttaggattgatggtgatgagtgctacccgtgctcccatttcctttgctttcgcagcatggttgacaagtgattttgtctctccgctgccactgcataccaccaatacgccgccttccttgatattcggtgtacacgtttccccaacgacataggaagccactcccatatgcatcaggcgcatggcaaagccctttacctgaaagccgctccttcctgctccggcacagaatacctcgtctgcctcatcgatcagctctacgaatttttctgcctgttcctcatcaatggcggtcagtgtgtgtgtaagctcctgcactacgattgctgcatattctttattgttcatcaacctgtcctcctatttcagatgctgcttcatctcttttgcggcagctgcacggtcttctgcattgcagatggcaccgccgacaacgacaaccgcagcaccctcggatgcaatcgcatcaatggtcgcaagcttcacaccgccggcaaccgcagatttcgcatgggtaatcacacggttgacgatcatcagctcatccagcggattctttccggtctgctgtacatcaaatgccgtatgtacacagatataatccacacccatggcatcaatttcctttgctcttgtttccaaatcctttaccgcgatcatatcgatcataatttttccattgtatttctttgcggctttcacagcccccagaatggtttcatcgttgctcgctcccaaaacagtaacgatatccgcaccggctttaaatgctgtttccgcctccagttctcctgcatccatgattttcgcatctgccagaatttcaatttccgggaaatgctgcttaaactctctcaccgggcgcatgccctcctcaatgataaacggtgttcccacctctgcaatatcaacgctgcctcttgtttcttgcagcagggtcatgcattcctccagtgtcagtgtatccaatgccagctgtaatttcataatcctagttctcctttaccataatcagttgtttgacctcactcacgcagtcctgctgcccttcctgcagctcgttggtaatcatgacatcatagtctgaaaacttggcgaactgataggtggctgtctttgtgaatttactggaatcacaaagcaggatgttctttctggaatgcgccagaatatgacggtttacctccgcatgctccatggaaaaggtcatcggaccatccatatccataaagccgtcgcatcccataaacgcaatgtcaatacgaaccgtatcaatgacattggtggcgtaatatccgacaagcgcacgtccttttttctgaagctttcccccggtcataatcagatccagcccgctgtcacagatgatatccgcaatcggcagggaattggtcagtaccgtgatgttcttcttcagacgcagcagcttcgccagctgcagacaggtgctgcctggatccatgtagacaatggcatcatcctcgataaattccagtgccttacgggctatcagctgtttttccagcgtatgctcctgcagctttacatcaaagggcagctgataataggcattgcgaacgactgcacttccatgcttctttgtcagcacgccgcgttcctccagcaccttgagatccttacgtatcgtttccgttgtcacatccagctgccgggcgagctctccgacccgtactctgccttctcccaaaactcgctgatacagcgcgtttcgtctggcttcacttgctttcgacatgtcgcttcaccacctttgcacatggttagtgtacgtttttctttgcctatcgtcaatctgatttcgcagttttccaaaaaaagaagcataaaaaattggttttaagacgaaatactgcgaaaaatcgcaaagttttggtttttagtatttgaaacatattcttttttgttgactgtgctataatactcttggtttaaaggaggaaatcgcatgaattcttttgacttacatatgcattcctgttacagcaacgatggtgaatttacaccacaggagctgattcatatggctgaggaagcccatttaacaacgattgcactgagtgatcacaacacgccgaaaggaattgcggagatggtccgtctggcagaggcaaagggcatccgcgtaattcccgccatggaatttgatacgctgtttgaggagctggaggtacacgtgctcggctacggcatcgactatgagcagccttattttcaaagcctttttaatgctttaagtgaacgaaaaaaagccgtgcagataaaacgtgtggaaaaaatcagggaagtctttgacctagatatcgatcccgctgcgcttttaaagcgatatgcaggtaaaaatccgtttcctgcaattgtgcaccatatcatggaacagtataaggataagaaagagtttgcggattatcagcccggaggcagacgctgtgagcctcagccggtgaatttctactgggatatgtgcagtgccggaaagccctgctatgtccgtgtggaatatccatccctgaaggacaccgtacagcgcattcacgatgccgggggtattgccgtactggcacacccatggctgaacttctatcaaaaggaggaacgtctgcaaaaagcactggatgagggaatcgatggaatcgaggcctacagcaattatcatgaagcaaagcataaccgctattatgatacctattgccgccggcatggtgtcctgatgacctgcggcagtgattttcatgggaagatgaagccgaaaattcgaatgggagaatacggctacgagaaggatgacggggaggacatcctgcaggcttttttaaagcggctggcaaaataaaagagcatatatataaaagccaatgctcacaggaatgcgaagctatcctgtagacatcggctttttctacgcaaaaaatgaatcgaaaaggcgtctttccgccatgcaaggtaaggctgcggcggtttccttattcggcgaagcctctgccaaaaccgtgaggcttatcaaacagcagcttcattctaggaattcaaagcagcggttacggtttccttcagctgcgtatccttaatttatttaacagctcacacagcatttcacgctccttttgtgaccgctgacggatatgatggataaaccggctctgccactcctgctcctgctcgatctccctcaaatcggcatcatccagcttccatgcctcatgaaaattaccaccggcaggatgcagcagctttaacaggacagcgatttcctccagtgacatctgttcataatacgcatcatactcctcattcataaaaacagcattctccaacagatcgatcaggtcataggcactgatcttctgggagcgtacatactgaattttgtcctgcaggcaggcatatttctccacctcctccagcagcgccagaaacgtttcctcatctactccctgtgtcaggtcgatgacgaaacgatcatctactgcttcctcatatacaagcagagcataagcatcttctgtgaagacctgtagctgcgcctgcagctgttcttcaaacagtgtgagatagtctgccacgcttttccccatacggacagcgattgcatgattgacctgcccaacagcctcctgcagtgaacaatgccgcagcagcgcccgcagacgctttacatcctgctctgccagcaaaagcgagggctgctgaaacagcatgagggatgcaaagcactgataccagagcagctcacaaagattcaagcctaaatattccacagtcactcccttttgcagttcatagcgtcggagaaattccggcagctcttcacgaaagtattcgcaaaaggtatgctccagtgcaaagcgttccatataatacaggacaagatccatcccatcgaggtgatacatatcatgaaacagaggaatcccgtccaccagcggatagtccagatcctctgtggtgtgactgtagtataaaatcccctcataggtgctcagctgctcgagatagtgcggtatctgttcatccatcacactgttgtagcgctcattgcaaaacggcagacggtttctgcgcagctgattcaacaggtttcttgtctgctgctccttattctgtaaaacaagcagaccgcgttcaaagcatgcatctatttccagttcctgcaaagaccgttcttccatctcctccagtccctgtaaaaccacatagctgatggtgtttaaaatacgtttatgatccgccatgctcaaagaggtgctctgcttatggttgagcaaaaggacaagctcctgcgccagctgttcgcactgctttaacagatattccctgcgcttttttgtgatttctcctgcctcctgtgcatgctgcagcaagacatacagcgaatcgcgaacacgctgttttccaacaatatatcccatacactactcctcctgtgaccttttcactcgctgtaaaatacgcaaagcgagctgccggctgatttcaccgtgataaagaagatactcttcatacagtatttcacacagctcctcatccgatacctgccagcttatatgactgcgcacatggtaatacagccagatcgactgttttaagtgcagcatatatgttggaagtgccatgtagggagattttaaaaacggccccagtatgtcgaacagacggtcctcttttgtttccacccatcgatactgtcgcaatgccagctgctgtgattgatacaattcctgcatctgctccttacgcagctccagtccgatgcaggcaagctcccttctaagaccgctttccccttcctgtaatacctccagtatgttctgccttctcattttgcatacctccttatccgtgtctaatagatatatcacggacactgtttgcatacaagactggaaaaaccggcccatttgtggtatgatatagacagaaaaactgtgaaagcatacgattcggtatgcttttttcatgtcgtccccttgctatcgaatacagcccatcaaattccattcttccaagtctgtagcttctctcatacgggtgaaaattaaagctgcattcgaatgattacataaagccttacatttttgtgatagtggaatacaattgaatatgatataatgtacatgctgttgggaaggtgcgaaacattatgaagcaaataccgaatatactgtccgcagtcaggatcttactgtcatttctgctgctggctctgacaaaggatacaaccttgtttctgattgtctatttcatcataggaatcagcgatgtcctggacggatggctcgccaggtccctgcatgtgcagagtgagctgggtgcccgtcttgattctatcggtgatctggcattctactgcatttcactatacatcgttttctttcagatgaatttgaaaatcatgaatctgatttccatgctggtgctgtgtgtcttcgtactgaagcttgcggcgctgctgctgacaagatggaagcatcatatctgggcgagtatgcacaccataggcaataagctgaccgggttgctgctgtttctgctcgttccgctttgcgtggtaaccaaaagtctgccgctgattccggttgcactggtcatcgcctgttcctacttagctacctttgaggaaatgctgctgattttgtcacgaaacacgtatgatatcaatacgaaatcattattaaaaaaataggaagccgatctgcagctccaacgcagattatccggtaagaagaaggtttgaagccataaagcattctcttcctgtctcatccgaaaggatctgcctgtacgaatacaggctttttttctgcagatgctaaatgcctgcgcacgctgttcagtgtctataaaaaacggattccccacccttatcggcagagaatccgctgtttatacttcctcgctgtttccttcttcctgcataagaaccagctgtactttatggattcgcttgtactttacttccttcacctggaatttgatatggttccagataacctcacgttcctctccgtcctctggtatctgtccaatcagatccagcagaaatccggatatggtttcatgattgtcattttcaagctgcagtccaagctcctcattgatatcatctatcggcatgccgccgtccagcacgtacgtatgctcgtcaagcttttcaatctgcgcttcatcatcctcatcgtactcatcctcgatatctcccataatttcctcaacaaggtcctccatggttacgataccgctgaagcctccatattcatcaatcaaaatggctatatgctgatgcttgctctgcatctcccgaaacagatcgtcaatgtttttgctttccagcacaaagaacggcttgcgcaggatgcgcgatatatccacatgctcgaagccgtttttccttgcctcgactacaaaatccttgatgttcaggatgccgatgatattgtcgatggaatcccggtaaaccggaatacggctgtagcgcatttccatcagctcatccagatattcactctgaggatcatcaatatcgatgcagaatacatccggtctcggagtcatcacctcttctgccagaatatcatcgaaggcgaatacgctgtcgatcatatcagcttcatcctcatcgaagagaccgctctcctgcccgctttccaccatggaacgaatttcctcacgggaaagagattcttcaacattttcatccttcatgccgaacagacggagtacaaaccgtgttgaccaggataaaattttgatgaagggcgatgcgatttttgaaataatgagaatcggctttgcgcagaacatggaataggcttccgcattctgcagagcgatccgcttgggaacaagctctccgaaaatcaatgtcacgaaggataacaggatggtaaccaccaccatggagatcgtttctccataaggaatggcccaggcctccagaacagcaccaaggcgtacggatataccggttgcggcactggcggagttgaagaagccggcaagagtgattgccacctgaatggtggataagaagctggtaggctcctgaagaagcttttccacaagcattgccttgcggtttccctcctccaccttgcggtgaatcctgtttttgttaacggatacgatggccatttcactcgccgcgaaataggcgttgatcagtgtcagtatgacaatcagcagcagctgcagtgtaatggaagattgcgcggggtctgcgtccataaaataatatctctccttttctattatgaatttgattgctattgtatcagaggttgtggcatatgtaaagagccagcaccagatggaattgtaaattttttataaatccggaatacctgaacacaggcttgtccttttctgcaggcacggcggaaggaatcaaaagctctctgcgatatctttactcagcccttcaacaatctgaactgccagttcaacagcatgctcatagtcctgataagccagaatcccataggaggaatgtgcatagcgaaccggtacaccgatgacgattgttggaatgccgaattgtgccgtatgtgtaataccgccattggtacctcccccttttcgtacactctcctgaaccggaatgtcatttgcatgggcaagctctaaagcaaagcgttgaaatcttggggatgtaatcatggaacggtcgaaatgccgcagcatcggtccctttttcaaggcactttgaatcatatattcctcttcgaagctgtcatctgcagggcatccttcaaaacaaatcacaacatcgggcttcacgttgttcatcacacaggtcataccgcgttcgccaacctcctcctgggaggacagggttgcactgacggtattcgtgagtgtacgtccatgcagtcgacagagtgtttccacaacggcggcacatccgatacgattatcaaatgcctttcccataaacgttttatgctcttcgtcataggtacaggtaacatcaggaacgatcggtgcaccaataccgatgcggaaggattcctgtacctcctgtgcactcgtcgcaccgacatcaatcaatacatcggcaaaatccagagcctttccctgctcggaagcattcataaagtgtaccggcttgctgcagacaatccccggaatcagtttgccgtctctgtttttaatgagcaccttattcgcaatgatgttcttcacatcccagccgcccagcggcagaaaccgcaggagcccgttgcttttcaccgcctgaacgatgaaccctacctcatcactgtgcgcatccagcatgatatttacaccaccctgactgtttcccttcaaattcatatacagattgcgcatatggtcctctttacacgtacagatttcacgtacctcttcctgtgcatacgcaactacagcatcttcaaaaccgctgggtccaaaggcatccgaaaattttctgattctatcaatttgtttcatatcgtattctcatcctcttttctattccctattatagcagagaatgcgaaagagttcatccggaactcctattcttcttcagcttcttctgtctccagaccaaatgatttcggatagaaaggcagctgcagagccttgcagacagccatcgcccattcccggaaccaccagccgttcgcggttataacattcccgtcctgcacatagccgtgaagctcgggatgctttttctgctccttcatatcaagcaatcccttcatctgcccagcactgagctccaccgaggtacaggcaccgcccgccatgaagcattcccgatcaacggaagcaacatagcgccgttccttcataatgccggcattcaccagaatcatgggagcacaggaaatcgccgcaatcagcttccctgctttatcaaaggagcgaatcaaagataacagctcctcgtctgccagaatccagtcactgctgtcatcctttgctccgataccggttaaaaccagcacatcataatcctccgcacaaatcgttccccaggtatattcgccaagagcaaggaagccctcctccgcacgcaccggtttcaatgtcttggctatgtagtcgatctgacaatcggccaaagcaagggattccagcaaaacactaaattcgaaattacaaaaaccgtcgtataaacaaactgctgctttcatatacagtcctcctataaaaaaaaccttctgcacctgttcaaacaggattcgaaggctctataaattcacactaaaaaagctatggaaaaaaattttggcagcgtcatgtgaaaaagagtctgtaatccattggtgaacaggcgtacatctgtatgtctgattcaaaaaaccgtctggattatttgctcacttcacatcacctcttgcgttcattatacagaaggagaacgcaaatcgcaagcgctcacagtaaaacaccgctcagcgccaatgaaacaaatcacatagaatgcattgcacgtaacgtgttgcttcatccatcgaacagcgtcaactgcatggtaatccgcggcgatactgtctattcgttgattaattttccaagctcttagtataacgcatccgctgcatatcgtacgtcaaaacgaacgtcagcatgttcctgaaaataaaaaaaccccgatatctacggggttacctgttatcatggcgccttaaacaggaaaggaaataagaagtcttaatatgtatttaatgtgattattccgtgatataatcagcttttaaagctctcttattctatagtattttatatatttgtacgtcaaaaagacgtcaaatatttaaagagaagatacgtctcaaatatcttctcttctttctttttataatatgattctatttatttgcaaattctggttgtgtccaaatatcatatacttgagtaaatttattttggtctgtaacaataccacatgaagttaagtcgttattatatcttatccatctggcgtagctattatagtatgccttacctataccaccaaatgagccaagaactgctgccaatacaggaacagaaatagtagaagcagcagcgccagcacctactgttgcacataagtcagcagcatcatccatttcatttgctaatttttttgcaccactagtattacgtgctactcgcacataattccatcctgatgattcccaattctgaccacacattgttgcacgtgcagtaccacgtgtttcaacttgacatgctccattagatttttttacatctttaaaatcgcgaatgtttttcatagcagaattaaagaaagattgttttgtccatgatgtattatattttttgttatatgcattgaagtcgtattcgtaaacaatttctctaatcttttcttcgttataaatatactttccatcttttaatgataatgtgtttgtaattttatcttgcattttcataaatcctgctaattcaacctcatcttcatgatttaaaactatattagtttcaatagtagtatcatatggttttacattaacacttgctgcactgacattaataggtgtgaaagcaatactacaagataaacaaagcataaataccaatgaagctaaaccaaattttttcatagtaaaatccctccttttgatttggttattctttgcttattcaactcatacagcatctgtcatatacatattattttttcccctccctccaaaattaaacattaagtatggcaatcatctattattttctccctccttttagatgatttaattatcttttttccaaataaataacgcttatgagaaaagccaagtctataactactaatataatataaaatgtactgctatttgaaataccaaaaaatctgtctttaataacaaaaaacatatttataataatcatcaatataaccaacttctgtgaaagagttaacttatttttcatcttgaccccaccttttcttttcctaattttattataattcaaataaactattttaaaagcattatattataaaaagttttatgatataatataaatatcgcaaaaactggtcatgatgatgaatgaccagtttttgatatttcatatatttaattattgtatgggatataatgtccgttattatctacatatccttctcctgcatccaaggcatcttgttgctgctgttgcatataatcattatactcatcttcagtaactggggctataagcatccctgtacttccatgtttttcttcaattttgttaactatgatattagtgagagctttataatcttcaatagttaaagtatcttctatgacatttttatttctagcaagaaaatcagtatattgataatagtattttatttcttcactaaaaggcttaaacaccacatagaatatacctttttcttcaagcgatttcactgtcttatcatccagctctccagtagctaaccaagaactagatacatccaatgcctcagccagtttatttaacattttttctcttggataagtttttccagtttcataagcatctagtctggtatcagcataatttatgcctattaaatcgcctatttctttccttgtcattctacgagcctttcgtactttttttaatctatatcccaagtcattcataatagtcctccagttttatattcatagtatatctaaattctattttttaatcaagagaaaacttcatatttaatacagaaatttatttataatattaaaactgaagtttttgttgacagaaacgttttcacgctatagaatattaatataaacttcatatttaaaactgaagtttatagaaaggaggacattgtcatagaatctttgaatcaaatacgtatgaaaatattatgcaaaggatatgccaacaaaaaagatatacagaggttttgcccatgtggttataaatgtgcaaaatccatatatgatagtattgttgacgatatcaccaaagacggacataaggttagcacattaggaatacctacaaagcgacttctaaaattccttgaaattagtgaagacgagataatgaagttaaccgagtatgaattgaacatgaattttaaaaggctgagtagtcctttaactgcttagttcacttattgggcatagaacgctgaatacagttgcttatttcaatgatagggtgatatatcttagctgatattttttaatacctattgaatatttaagtcggtaactagcgctcatgtccttatgataggcaaattaagagaggagagtgttaatgtatgcctaacagagaaataatgtgtgagagcggcacagggcagtgtgatggtcacatcacaaatgccacagtgccatgtgccgtgaaacggcacattacttatcttgataatacccacacattggtacacgatatatcagataagtttaagccatatacagataaagtatatgaaagcggggcgattatcgaaacttatagttatgaaaatatgcattttaaaaagcttataaagagtaaagatattgcaaagcccaagaaggagaagaaaaaagcaaatggtgattacaagcgtgagcatagaacaataatcaggacgaaaaacaggttaaaaagactaatcaataccaatattaaacaatacaatgaaaaagataaattcataacgttcacattctctgaatttcaagaaagggatgaagtagcacgtaaattcaaagcatttaacagacgattgaagaaaatatattgtgattacaaatatattgccgtaattgaaagaggtagcaaaggtactgagcggcttcatattcattgtctattctttggtctaccttatattccttatgaaacaataagtgaaatttggagatatggtcatgtcgatatccgtgctattgatgaacatggtgatgtagcaggatatattctgaaatatgttgaaaagaccttaactgatgacagctacataccaaaaggaaagaaattttattttacatcacaaggattaaaacaaccaaaagagctatatcttgtgaggaaagaatttcaaggttatattcaaactatggatttacaatctgtttgccattatgaatacctcaatatttatgatggtgatacagtaaaatatgaaaagctgcttaaacattaaagtatagtaggaggaggcgtaatatggcagtatacaagaatagggattctggcacatggtactttcaatgtagagtaaacggtcagagaacgagtcgtagaggttttaaaacaaagtctgaagcattgaaggctgaggcaacgttgaaagaatctatcatatgctctagaaaggtggatgaaattactgaagagtatatacagcatcttagaatacatgaaacctctagtgcttatacaatagagagtacatacagaaaccacataggctctgttgttggtagaaaacgtattgataaaatcaaattgcaggacataaaaggtttacaaatgattatgcttaaaaaaacttatggaaaaggtaggcactatacgaataaaacgataaatctagtaactggtactttcaatatgattatgaattacgcagtaaaatacggatatatacgttctaatccatgtgctaattttgaaagccttaaaactgtgaagacaaatgatgaaatcaaattctggacagatacggaatttcagaaagcaattcgatacgaagatgattttatgtggtattgctttcttgtacttgcctatatgacaggtatgagaaagggagagattagaggattgagatggtcggatattgactttgacaaccatatcatatcaataaatcgccatattagtgacaaggttatgaaggaagatagaaatacagagaatgagaaaagagtaatacgtggtagaaagaatggacatgcccataagattgcaatggatttccatatagaaaatcttttaaaagaattacgtaaggataatagttttatagacgggtggagcaaagaaagctatgtatttggcatatttaaacctattgggcaaaactcacctaaaaggcatctggatatcatcgctaaaaaagcagggataaaacagataacagttcacggacttcgtcattcccacgtcagctatttaatttcaaagggacttaatgcttatgaaatagcagaacgcattggagatacggttgaaatggtttttaaggtttacggacatatgtttccaaatccgcaaagaaatattgtgaatgtattaaatagcaattttgctttcattcaagaaagagataaaataaaaaaaggacgtcaaaacgaacgtcaacatttccctggaagtataaaaaaccccgatatctacggggccaaatgttataatggcgccttaaacaggacttgaacctgtgacctgccggttaacagccggatgctctaccaactgagctattaaggcgtttcttaagtgcttaaatataatatcataagattttgtgtttggcaagaaaaaatagcaaattttttaggatttttttaggattttttatggttttatttctgtccacagccatgcggatgaaagcggaagccctgccatggcaagttatcctgaatttagattatatttataaccgaatgattccggctactgtatccgcatcctcctatgaaaagcaatttagagaagcagcttccaaaggattcagcgttcttcaaatagcaaaaaacagcggtttcccgctgttaatatccaccgtcactagtttctttctgcatcagcttcacaccggcacttgtaccgatacgatctgctccggcttccaccattttctccatatcctcatagcagcgtactcctccggctgctttcaccagacaacgccccttcacggtatccttcatcagcttgacatcctcaggtgtggctccgcttgttgagaacccggttgatgttttaacaaatgcagcaccggcttccacacaaagctcgcatgcttttacgatttcttcctttgtcagcagacaattttccagaatgaccttgacacagttaccttcagctgcttccacaacagcttttacatcagcgcgtaccgcatcgtaatgtccggccttcatttctccgatattcaaaaccatatcgatttccttagcgccgtctgcaatagcagcagctgtttcaaaagccttggctttggtactcatagctcccagcgggaagcctaccacggtacaaaccttaacgtctgttcccttcagcagctctgcacatgctgatacccagtagctgttaacacatacgcttgcaaaatcatattccttcgcttctgcacacagtgtttcaattttgtcatacgtagcatctgctttcagcagtgtatgatcgatatacttgttcatttccataaaataacctcctgcattatctttccaatgtacttttagtatatcatggaacccatagaatatgaagttcatttctcttcatcactagttacaattcctggtcttcctgaatgccttcatgatatctgcgcatccaatagacgcgaacaaaggggtccttcagaaaatactgcagcatacgatacagcaaaaggtagcgcagcagctccgttacaataaggattccccaggaaagcagctgatagttctgcgtctgaaacacatcggcaagctgcggaagggtgaaaagcagccgcagcagctccatcccccacataacgggtataatccatcggctccatggcttatagagaaacagtgataccgccggaagagaccagatcaaggcggaaaacagagaagccagcagcaaggttcgctgcataaactgcatcccttcatgatcgctgctgtaatatcggaaaacaaacatgagaagatacagcagaaccagcataccatactgatatagcagcaaggcaacagagcaggcgcggatacggtttcttgcccgtatatccagccgatgatcatgctgtatatgctccttctgtgaaaaattgaccgggctcatcgcttttccctgcatttcattgtccgcttccgtgctatgcggtttccatatgtagattatctgcgaatttctttgcaggctccacgacatatacaatgccaaagctactttccccgccaccataagggtaaatacgattcgcagaagggaattctcctttgcgatatcaattcgaaacagcgcaggcagctcatacagcgtatagagatttacaagagacagcacctgaaataacagcctccccagcctgcggcagctccacagcatacgaatcaccgcaagccataccagcaaagcaacactgcgaaacaggaaattgcgcagaaaagctatatgaacatcctccagcatcagcttcagcagaaaataggaaaataccatataagcaattaaaaatatagaaaacagcaccagtagcattcgcagacggcgaacacaggctctgcgctgttttttacgttcccgcagattttcttctctcatcgatatcatcacctgtccttattatacaggaaaagcataccatttgcacagcacataagcagtgtgacgtacacaagttgtaaagggaagaaagggctgctgtcatctataccaatataaccttttgtgtaatctttcaaaatataaaaaaaagcaggacatcctgtaaagcaatcgggatgcacctgctgtttgttttcaacatatagccagctttcgtaaacgtatttctgtatcggaagatactattttttaaacggaaaatcctcgatatccgaaggattcacaaaggttggattcggtttgtcaaaataattggatgtatccagatcccaggcattatgggtatccccttctccaaaatccttcatttccgtatgcgtcgttagaatatgcagcagattccgtaaggtatccatcgcttttttcgcactgtccagcagataggaaaaggcttcatccgcaccatcatcctgaatatagcgaatcagctcctcatatatatgaatctgttcttcctcatactgcatatcccgcatcactgcagcagttaaatcattgttcacatggtgctgttcctcttctgattccggctgacagctacagtgcttctcctgcgtatggcacggcttgataaattcaaaaacaggtgtatcatcgtttgattcatcataataacgatcatcctccccatgcatttgatgaataatacagctgagtacctccatatcactgatctgtcgtgcacccagtcgcataaaaatatcatggaaggttgggttgttgatcatgaagctctgtcgtatatagactgccgcctgcttcaaaccgctgctgcagcccttcagctggcgatccagcaaaaggtagtatttcatatccggtcgcgtaatccgcacctcaaagggcagttttgtatcataaataaacatatgcatacctccaatttctaccgttagtatggaagcttttccctggattatgctataatatgaagcataaaaaggaaggtacgtttatgaaagaaatcaaattgcatacaaagctaaccaaaaagatcacagtggaagaaagcatgctggcctcccatgttggcagcggaattgtagatgtctatgcgacaccgatgatgattgcgcttatggagaataccgctgcagcctgtctgaatcagtttctggaggaaggagaaaccagcgtcggcgttatgatgcggacaactcacgatgcagcaactcctgctggtatgacggtaacggctgaagtggaaatcacagctgtagaccgcaaaaaggtttcctttcacatcattgctagagatgagagggatttgatcggtacagcagaccacgatcgcttcatagtaaaaaaagaagcctttgaagcaaaggcgctaagcaagctggagaattcataaatacatgtgcagccgccgttcaagattctttcccgtttgtgggtaagcttaaaacagggagacttcaactcgattgtattcatcaatagaagttgaagtctcccttttgcataccccctaacgtaaggaggacccccgttaaagcagctgctttttctatatctgcctgccgttgtgatgatggtattgacacaggcagccccttcctgaacagcaaaccctgtgaacgggatacagaaccatatgtacatgtatgaataagcgaatgcagatgattttgaaggcactgttttgggctttcgcttatcgtcagtaaacgccggacaatttcttcctgcatgcctttgtgcacatacaagtctgtatcagccaattgctctaagatagagaagcttccaccgtttcctgagaggagatgaatgcagcagctttcctgcctgcttttgtgcgtagccgtaaacaagctctgcctcctgccttgtcatcgcatgcggggaatataaggctttctcacacagggcgcgtatagtcttcggcaggctttcatgcttcataaagctgatcagataacgatagctgtaatttatcgccttttttgcatcccgctgcagacactgtctttctctgtaggcaatacgcagtcgtcgttgaagcacacaaatcaacaccggcaaagctatcagtaaggctgcaagaccaaccttggcaaagcctgcaggcgtatcgccttgctccttttcgatttgttgattctccgcagcgttccccgttttcctgtctgtctgcttttttggtgtttccgtctttgctgtcgtcgtgccgccctgctcctgtccctgcacagttgtttgggaggacggcttgctttcactctcaaagcccggtgtcacctcaaccggaatccaccctttttccgaatcgaaaatttccacccatgcatgtgcactttcatccggtacctccatactgccgccactcatagctccggcctgaaaggaaaagccttccgcataacgtgcaggtatccccatataacgaaacagcataactgccgtggtcgcataatgcacgcaatagcccttcttattctccgtcagaaaaaattctacaaaatcccggtcatccggggttcttccgggcttcagtgtatagctggtcgtttctcttaagtattcctgtatggtcgtctgaatatcatatgtcagatgttcacccgttagggaggtgagctttttaaaaggcttacgttcatcaaacagcctttttagattggcgggaatctggagatagtgctccttgacaaaggcgggatatgcatctgctttcacagtggaatcaccatttatggtcgtactggataatgcataggcagtatatcgcatggtatcatcatgctccagacggtaagcgtcataccacggttttgtttccggcaaagcctccttcatcagatacggtgtcagggcatagcgtttggatgcgcgatgatcctctatctccagatgcatcaaagcccctgttttttgcaaaatctgtgtaaaggcgggatttttcttatcaagccacgtatccacatccttccagtcataggatttcagagctgcatagctggattccggcagcgactgccagcgattatcctcatacagcgcgccgctgtagcttttcaggtagatggtgccgcgtgcatcctcagatcgcacaaccagctgcgttgcaccggtgtaataccgatttgccgcctttcccagatccacctctccctcatcttccccggcatgggttaggaaataggcaagctcatccacacgctgcagcaaccgctcacggagcgaaccgctggtgcttcgcatttcataggtatccggcagcgaggtaaaaaaggtaagcagcacgcagatcacgcttaatccgaaagcactcagccgtacatatcccccatgtccgtttgtcactccttttcgtgagagaagcagcataaaccagaatatgataagcgaaacggcaaacagccagggaatcggtgtctgataaagcagtgtaaaaaacaccgggagaaaggagagcataaataacgcaaaataacgacgcgtattccagaaggtcagcataccgcaaaacagccatatgctcgcatacagcagcagccaggtcagcgaaagccggtacagcatggcagtatcggttacatcgtagggatagaacacatagccgctggcatcgtgatacacctcagtgataatattataggcgatatgagccccctcctgcagcagtgaaaagctgagtaccccaagcagaagcatgcctcctgccagtatcagtatcacctttttcctgcggcgaagcagcagacggttatacacaactacagcaaaaagcagaaccggtatgtacagcatccagagaactgcatcccaaaaaggaaaggcgaacagaaacacaccgagagaggaaagcattcccatcaaaagcaacagcgcgggtatcacttgttttttcatataccggcctcctgttcgaaaagagccgcaaatgcctcgtccagatacagggcatcctgcgaatcgcgggatacttcacaaaagcgcggcatggatagcagttttcgtaaaaagccttccatatcctgaggaccttgcagctctgccgtctgtcttccacctgctgtccgccagcgaatacgaacaagatcctgcggacttgctttccgacagattccacaggcgattgccagaaggcgctcacagattttctgctcctgtggaaaacaaagatgaagcagtacaacggcagattcctccttctgaaattcacgtaccatcgttttctgcaaccgatagcttgccttatagtgaatccggcgcacaggctctccctcatggtgctccttcagctcataatcactgctgaaaacaccggtgagactctggcgggcttcctgcaggaggtttgtatactgcacttgcgtaaccgtacagggctgcgggaaacaaaaggtcgttacctccttgtcccatgattgggttttgcgaaacagtccgagaagatccctggtctggatggaggtcagctgcagctcatactttccacttcccagcttcggtatttgcaatttctgttccctgtgcttcacttccagagaaatcgtttcgctgctttcataaaagcaattcttccacgatccctgtatccgaataccactgcatacaagcaggggaagactggttggcatatgaattacacagccctttttactcgttttcagctgcagcttcaggaaccggtttccggcgataaacagaagcaggctgagtagaggaagcataagcagcacacgcagcaggagataatacagatacccgtcaatgcttatccatgccagagcatccagaagcagcagaagcagataggcgagccaggaacggatcatagccccttccttcttgtgtgcggtggctgtatatggtgcaggagctgtgtcagcgcatcctttgccgctgcggcatctatgctgtgtgatggctgcatgagaatacgatgggcgatggtatccacaaagacattctgaatatcctccggtaccacataatcacgcccctgcaaaagagcacaggccttggacatgtcaagcagagctacccctgctcttggactcgctccccgataaatgcgctgattgtttcttgtcgcctgcagcagctgaatgatgtaatgataaagggaatcgtgtacaaacacctccctgcaggccttctgcatttccagaatctgggtgcgctgcgcgacacactgcacacgatagctttgcggattctgcttacgcttgaggatttcaatttcatcatgctcctgcggataaccgatttccaggcggatcatgaaacggtccagctgactctccgggagctgctgtgttcctgcagagccgtaaggattttgtgtcgcaatcaccagaaacggctgttccagcgtcatggttatcccgtccacgctgacactgccctcttccattacctccagtaaggctgcctgtgtacgggaggaggtacgattgatttcatcagcgagaaacagattggtaaaaactgcccccttgcgtatctgtgtcttacccgtctgcggatcaatcacactaaagccggtaacatctgccggtaatacatccactgtaaattgcattctccggcaatccagctgcatcgcatccgcaaacgctcgtgcgattgttgttttccccacccccggcatatcctccatcagaatatgaccattggccagtattgccatcaggattttttccagcagctcatcctttccgatcactgcctttttcacttcctgtaatattcgttcactcgttctcatccgttctcccttcaagtattcagccatcctacttttacctattaaaaacacataactacctttattgtatacaatgatgtgcactttaggtcaacaaaagatttcttaactttttatgaagattgcactttcactgtcccctgcttcagggatttaaccgaaaaaaagcagccaaggcatttccacctgcttccggctgcaaagttaaagctatttgaattcccgacgcatgcacacaaggtcttcctcctgcattcccagctgacgcagagtgacttcctttttgtttggacaggctaacggctgaatcatataggagcaaagcgtacaatatccggatgattcgctacgacggatacatgcatacccgcatttgcgaatacagttctcatccacccacagtgccagctgatccaacgcattggtcgctatgagattggcttgttcctgcggtatacccgcatcgaggagatagcggaacaggatatctgcataggtcagaatatattccataagaaaaaagttttctgcattgttcttctgcatacgcttcggccacagaggaagcttgatatgatttctgatatagcgttcctcctccacatgcttgcgcggatttttcaggcattcatgcggacattcggcacatttatataaaaattcccccattgttttcaacagctgaaatttaaaggtggcaaaatctaccgtcactttaaattcctgctcgattttaggaaacgcatccgcacacatagtcagtgcagcatccacggtttccgcttcaaatacacccagctttgtgattggctgcggcaaaaacatcatcagatccctgctgttcacatatttcatttttcatcaccatgccttatggtacactattttcagacaaaaagaaatacagttgaaatattttcccttactttatcgtataccggatagaaggaggcgaagatcatgaaatctatgttcctcatattttatatgcttataaattccatgggcggctatctttttcaacagacagcagtagagactgcctacccggatatcgccagaaggtgcccggatcttacattgcatgataccaatgatctcgtagacggaagtggctggatatcctttttaaagggattggatactgtttctttatcaacgatacgcataaaggatgcgagggattccacgcaggattttctgatacgctatgatgcattaggaaaaagctatacgctgacaaggcaggatgacagcgaacatgccgtcacctacagccatttgattcgcatggacggacagcgcatagcggatatgcagcttgacgatatgtgcatctgttttgcgaataatccagcagaatactggtactggtatctttgtgatgatgtaaatataaagcctcaggacatcttccgggagccgaattcaacaaaagcgcagttattgtttaccgtgaaaaagacctgagaacaagcaatctgcatcgtacaggcatcctcattcagatacaagcatgccgtgtataataaaaaaggattccgaccgttaggattggaatccttcaatatgttatcatggtggagcgtatcgggatcgaaccgatgaccccctgcgtgcaaagcaggtgctctcccagctgagctaacaccccatgtatattgaaattcgatggtgggcctgaatggacttgaaccaacgacctcacccttatcaggggtgcgctctaaccacctgagctacaggcccgtttccatcgaatgctcatatataataccactacttttttcgtgtgtcaacaaggtttttatcattttttcacaagcttttaagagattttatatgctaaagacacaaagctgataattttacgaagccgcaagttcttataccgcttcctatatgaatatcgtcatgtatactctcggttattgctttttatgtctgtatcacaaactgcgtctaaagatctgcgataaaacattgacaggcacaggaaagccggatcaaattacgtaaagtctgaacacactcatatttcctctttctgaattatctcgatttctcaaacatgataattcaacgcacgggaagtgaaaaacttacctgttacagcacagctcgcatggtatgttcgtatgccggcaacaggagcttttgcaatcgaagctccattccctttatataaaactctttacgtatttcactgatgatttctataccgttatctgcattgggaatagcataaatgaaagcagttatcgcatccatatgcctctgtatctgtggaacgacacgctttactgcattatgaatatctttatcttcaagcttcaatagcgcaccgaactgcagtgcctttccgtcgatattatatccggtgactgtgctgattgcactgctgagaatcctatcttcattcttcaacatgtcgtttattttctcatcggaaatcttcgtggaaaaagaagcaccgttatcaaatacaggcgccagcgctaaactgccatcggaatatcgcaggataccccagtttccgctattgcgatcattattatttatcagcccgtcgatcatgacacaatcccagaacctctctgacattccatcaatcatatacaatagggaattatagttcagatgtgcctttaccgcgtgaagacttgtactgccaacactgttgctatcggttactgtatcttccagaattgcctccagttctttattgtaatagtttttgatttctctgaattcctgtaatcgaacatgtgaatccgtaaaatccttacatgcaacaaccagtttgttatcctttgtccctaatttggtttcatgtacaggatagccaagaatctgataaatatgactgcctatatactcagataacggagaggttgtataagaaatttccgtttttctcattccctttgtagatttaggaaatttcagaatccagtcctccccctgataaatgattccaagcttactgccagccatcccaccataggctttgttattttcctgacactcgttaaaatcgatcaaatacatgtgtttatcctccacgatatctttgacataggatatccctctgtttgctggtcatttctttattgataacaaattcttttgtaatattctcaatgaatccacatctgtcaaagtatgaccagtcttccttccgatccatttcctccagctcatccaccagctcctgaatcatggaaggcaaagcaaaatcaattttgactgaatcgttgatccagtgatagcttttatccatttaatcacacccttttaccaactgtattatagcatgcattgttttcacaacgccatacgatcattcagaaacgcaaaaagtcggtttgtattcctgtaatcagtcaaacactcataaaagatccaaccatgtatcttccagtttatcctaacagagaactgacctttctaacgtaaacctgcgatatcacctgcctgactgtcattttcgtacaacaaaacaagccttggaaggaagcaaaagctggtcatcacgctttgctatgcttcatattattcatttcaattagtattttaaaatctttttctctaaagaaaagcgatgattatatttttcaagtttaaacctgaatcatcatcgctttttatgagctttggtcaacgcagtgaacagtatatgcctgaaacacgaaatgtaaacatggataacacggaaatcagaacaaaataaaaaacaggttatacatctctcaaaacctttaattaaggtcttttttaaccgttcggcgaaatgtaaataacctgatcatgttatatggtggagcgtatcgggatcgaaccgatgaccccctgcgtgcaaggcaggtgctctcccagctgagctaacaccccatgtatattgaaattcgatggtgggcctgaatggacttgaaccaacgacctcacccttatcaggggtgcgctctaaccacctgagctacaggcccatttccatcgaatgcctgtaaataataccacaagtaaaacatgatgtcaacatatttttaatttttttatcacaaaaagccgtcaagtcgaaatgctctctgttttccacaagccacaccggtgagatcaaagccggatttgtgctatgatagggtacataacaatgattacaggaggaaccagcatggactatacagaagcatttgagcagatcgatattttcagaatccatttaatcgaggaagaaaaaagtacattgaccgtacaaaaatacatccgggatattacaagactctttgcctacctttcttctgaaaagactctgacgaagcagtgtattataaagtataaggaggagctgatgaaatcctatacctcggtaagcatcaacagcatgcttgttgcaattaactgttttttcacctttatcaatcagcccggatatcgggtaaagctattgaaaatacagaaaagaacctgtattgagaaagagagagagctgactaagaaagactatgccagacttttaaaagcagcgcaggatacccataatgagcgtatgtatctgctgcttcaaaccatatgcgcgaccggaatccgtgtatctgagcatcgattcattactgtggaagctgtaaaaagcagaaaggcagccgtgcagaataaaggtaagctccgctatatattctttccatccagactgcgtaaacagctgctggcatactgtaaaagaaaaaagataacatccggcagtgttttcgtcacgaattccggaagaccgctggatcgcagcaatatctggaaagcgatgaaaaagctgtgtctccatgccaatgtcagcaacaacaaggtttttccgcataatctgcggcatttgttcgccttcaccttctacagtatggaaaaggatgtggttcgactggcggatatcctcgggcactcctccattgagaccaccagggtgtatacgatgaccagctttcaggaatatgagaagacactgtcccgcatggatctggtacgcctctgttgaaaaataccacataatatgcattatgtggtagcactcatattctgcttacaggtatattttaccatatattcttacataactgaggaagatatcatcagctattcatctttttttcttaaacagatcatttgcccagctgaccgtttccctgcctttgattgcagtcctgcctcctgcacactaacaatgtcctgtactacataatgcatattatgtggtacagggcttttctgttcacgatgtgtatcttgatttttgcacaggaaaggaagcacatgagaaaaacatttttttatctgaccaaaattatcctttgtacaggactatttctgtttgtgatacattgcctatttatgcggcaaacacagggtctttgctcagccattacagttttcatggaaccgcaggacagacaggagcgttgtctgctgcagattgaagtacgaggcagcggtactctgttcgacggcaaagcgcaccatcgaaacagcagtgaacgatatgcgctctttaaaggaaagcgaagaacctttcacctttatgcagatcagaagaactatgccatacaaatccggttgaataacaaagatataaccgatagcgttcacaacgggaacatctctatcaggagctcatccaaggttcagcagctcgttctgtatgtttcataagataagttctgtacaggctgtaatcaaggcaaagccggctataaacgcatcctacagcagcacatacagcgctcctttgccctgtcctacagattacggctgctatgaagcagtcattctattcgccataaactgtacacccgcctatacagcagctttcaaatcacattctcattcggttatcggtattctcacgacaggaaattgaaatattccagtatactgtcatacagcgtctgcgccaccttttgctgatattcatcggtgataagcttcgcacgatcctctgcattcgatagaaatccgcactctacaagagaaccgatcttctgcgcattattcagaatataataatctcccggcttgcttgtcatcttcgtctgcgtcagtgcgcggaaatgcttctgcacaatgtccgcaaataccttggatacctcattctttggagcataaaaggcctgagccccctttacacttgtgttaggataggaattcaaatggatgctgatgaacagatccgtcttgtcctgattgatcagttcgatacgctttttcatatcctcgcgtttgcggttcgaagcaccttcgcttgccagatcataggcaccgtcacgggtcatcgtcacatgggcaccgccttcctccagtagcttcttcaacttctgtgcaattttcagattgatttcctgttccttcgcttcgttgctgcgagcaccgtcatcctttcccccatgtccgggatccaatacgatttccacaccatccagtgcatggaaggcacgtttcgcggaaacggaggtaatgtgcgacagacagaaggatgctgccagtatggtacaaagcagtcctgcacccagcaggtatttttttcttttcatcatcttcaccttttcaagtatatgtaatgttaatcacaaaaatatcacagtcatgaaatatttctgtaattcgcgccggcacagacaggcgattgacccgataccacggacatttgcggcatacgctgtaaaggaggtgatattatcactacaggatatgtcatggttgaaaccatggaggaaaccgcacagcccattcccaatgcgcagatcagtgtctttcgacgggatgagcgcggatctatatttatcatggaatgcagtacagatgaattcggtaaaacacaacgtattgaattggatgctccggatagctcgcattcaacagacattcactcactgacacgcccgtatggtcagtatgatattcacgttgccaaagaaggctacgatacagaagtccgcaacggtgtacagatatttgcagaaaccgattcaacgctgaccgttatcatgcaaaattccggggtacggagtgtaagcaataccatcgatatcggtgagcatcagcttcatgagggaggaggatgtcgctcatgctagaagaaatcatccttcccacgacgattaccgttcatctgggaagaccgacagccagtgcacagaatgttaccattggctttgtcgattatatcaagaatgtcgcatccagtgaaatctatccgacatggccgtatgaagctttgcgggcaaatatctggtgtcagatgtcccttgccctaaaccgtatttacacggaatggtatcgaagcagagggtattcctttgatatcaccaattccacagcctttgatcaggcatttgttcccggtcgtaatatctatgataatatcgctgcggttgtggatgaggttatgggagattatctgaaaaaaccgttttacagggagccgtattatgcggaatattgcgatggaaaaagagctcagtgtccggggctgaagcagtggggaacactcgatctggcaaatcgcggatatgattcctatggcatcatccgatattattacggtgatcaaatgcaatttctggaaacagataactggcagccgtacaccccttcctatcccggctatgccctgcggcttggaagcagcggtcagccggtgtttatcattcaggagctgttgaacggaatcgctgtcaattatcccaacattccgttaatctatccacccgatgctgttttcggaccgcaaacagagagtgcggtaagagcctttcagcggcagtttgaccttaccgtagatgggattgtcgggcagtccacctggtatcagatttcccgaatttatgtcgcagtccgcaagctggcggagctgggaagtcttggcagattggaaggttattttaccggtttatggaccggaaaggtgctgcgtcagggggatgtcggcatcgaagtgcaacagctgcagtatttcctttccattatctcagaaagctatccatccattccatctgtaaccgttgacagccgcttcggaccaggactggatcgcgccgtacgtgcctatcagcgggaattcggtctggccgtagatggactcgtcggacgttatacatggaattccatctatgaaacctatgcagcaatcgtaggttgacaaagccattcccgtaaaaggaatggctttcccgtaattttaaagcagtcactgtatttttaaattgttccggatacagcaggcagcctttaaagaaatactgcatgaagaaagctaaagatgtgtatatcgtatcacaccagtatttgcacactgctaaaaatcgcagaacacaaacctccatgtccgtactgagtgacctgtatcgaaattatgaaaaagctgaagcagaggagatggagcgatacatgagctgatttaacctttcatgtacgtgaaaggtatttacagaatactacacgtatgattttaccatgcctcttacgcagatcagggtacgcatataaaaagctgaaaaaccgaaagtagtaaattcctatgatccgactgcttccgccttgctattacagccctgtcaattacccttgactgcgtcacccccctttacactttgagagtccttttttctagaagcctttccaaaagaaaagagacagcccggtgtcggctatccctatatatcgttttatgattgctttagaattctttgtttttcataacacgacagctgatgcggtaggatatcgcaagcagcactaccgagaatatccctgcagcacctccgatctgcatcatattcattgtactcatagatgccagaacagcatccagatctacctgcagtatttcaagaagctttatgactcccatacttcccagcacggcaacaccaacggtaagcagcaatgctactctcccccgttctccgccgaatttcagctgtacagggatcatgacagccgcaaacagaaggacgatgcaaatatatagcagatcaatcggcagccagtccatgacgcttatctgcggattgcgaatagtaatgagaattcccgacagtaccaccgaaagcagccatgcaccgcctccaactaaaatagagaatacatatttttccttcacataggacgttctggaaaaaggcatggaaaacagaaaggcatagccgttgtcatattcgtcatagctgatcgtactcagcacaaacatagaagcgatcattgtgaaatagctgacaacgaaggttgattcaaattcagcaaacaacatggctgccgctataaatatcatgataaagaagaaattcttctgatttttcatcagcttgaagtccttaatcaataaacctttcatatctgttcacctcgtatcatcatcataatcacatcatcaatggaccctttttccacagtaagctgcggatagttttccatataaaactgtttttggctggtcagtacagcatagccatagggttccttgcgccggcgcagcaaatagcgcttatccaaatccgcatactgccgttcatccatcttcagcaaagcgtaatcactcagcaacacatctgtatcctcatgcataacaatctttccctcatgaatcatatacagatcatcacacagtccctccagatcggaagagatatgggagctaaccagcatacaggcatcctcatgctgttccatgtactcccgaagcaaatccagcagttcatcccttgcgaccacatccagaccggctgtcggttcatcaagaataagcaccttcgcatgatgggaaagagcaatcaatgcctttagcttggccttcattccggttgaaaaatcccgaatctgtttatccatcggcaacgcaaatctctggcactgtcgcagaaattccgctttttcaaatttcgtgtacatattgtccattacgggaaggatatccttgatattcagatatccactgaagccggaatcagataatacgacacccacatattctttttcctccggtgtcagctcctgtacaggctttcccaatacctcaatttccccgccatcaatggaaatcaatcccagaatggctttaaaggttgtgcttttaccagcaccattttgcccgatcagcgcactgatctgtccgcttttcagctccagcgaacagtgcagagaaaaggcaccgtagtttttcacaacattttgcagtttcagcatattcattcctccaatagcagatggaacagttccagcaggtcgctgtcctccatcccgcagcttctgcctttttgaatggccttgtccaaatcggcttcgatttccttcttatgttcctccatcaccagggccctgttcagtccggctacataggtgcccttgccatgaacagtaaccgcaaatccttcagcctccagattatcgtacgctttcttgactgtcagagcggatattttcagttccttggatagagaacgaacagatggcagaatatcgccttcctccagctcctcgctcaggatcatagcctttatttgctctactacctgttcataaatcggagtcatagaagagttgttaataatgattttcataagatacctcctctgttcacaaacagtatataacagtatataactgttgtcaactgttatatactgtttatcataaaaactttaagttaggctatcctcacattttgataatagaagctatctacaccgtagataaaacagaggatataagcttgaggttccacctgcttcagatggtcagagaaaacggtaaaaagattgcaacaacaaatcagctgaaaaacgggtgatttgttgtattgcatgttttaaatcagtgcatatgccggaaaaactgaggtattttactccgatatctataggaattgcttttatggggtgcatatctcatagacccgcgataacagtaagcctcattaccagtacgataccctttatgtatgtatcacttccaaccaacattccaacatccgtgcttccatctgataatccatggcacagtgtattccaccgatcgtgtgcttttttatcttttgtatgattagaaaaagcaacaccataaaaaaagggaaccgagggacactatgatagagaaatgctgcgtgcatgcctgatatgtagaaaagacagaccacgtaccgtatacaccgcatatggtctgcctttgtattttcctgaatcttaaaccggatatgttgcagcacagagaataccacctttaacagtgaatcatagacaatgccgtgaacacagtcttaagctgtatgtctgccttgtttttcctgagatgaatctgcctgtagtcagacaagctgtgccgggcgattgcctcttatttccacctccggattcaggcttatgcatacagccttgcgattgtctcttactttcattaccggattcagacttatgcataaagccttgcgagagcttcatacacgtttatcgcatccagaatgtgatatggctttgttgtagcagaaccagacgcatgagcgctgacaaacaaccacgtttcctcatggatacgtgcctgtgtggcaagacatagaccggctttctttgtatatccggtcttcccgcccaaaatatcatcctgtgacaactcgttttgatccatggtcatccgcatagtggaatagatggtcattccttccggatgcatattgctgggagccataacgtagttggttgcatgaaaagcctctgcaaatttaggaagctttaatgcctcgtccagtatccatgcaatatcacggacgctgctcacatgcccggcttcatcaagtcctgtacagttttgaaatctggtttgcttcagcttcagtttttcagcctgcgcattcatttcggcaacaaatgcgtcctcactgccatacagtgaaatggccagggtcatacatgcatcagcgccgcttggcagtaatgctccataaatcaaatcctcataggtcacctcctcatccggtaaaaaaccggccattgacgcctgctccttttccagctgcgggaatatggaggctggaatacgtacggttttctgcaaatcatcaatatgctgcaatgccgtatataccgtcataagcttggttaaggatgccggagcaatcgcttcttcttccctttccttcagcatcaccttgctatccttttgccggataaggatataattcttactgtataattcgctgcttatcttgatcggctgctcttctgtgtttctgatttgaagattcaccttatcctccttggaaatcatcggtcgtaaataacagacaagacctgtaatcagtacaccagccagcagcagttttttaaatcgtttcatcgtatcagctccttcatgactctattgaaccatgaattgcacagatagttgaaaacacagacttagcacttacttaattatcacttaactccttgcgttgcttgtttgttcacttcgcatacgctgaaaggcttcaggcaaaggcacatgctgaagttgattagaatgaggtcaaaagcaagtacttccatataaaaaaattacaagcgcggtaaacataaacatcgcagcacccacacagcggatgccctttttcagtctgaaatccatgttatccgtaaattgaaacagcataatcagccagcgtattctgtttcgtttatcaaatagtcttctccaatcttatccgcagcaaaaacgcattcactgcataacagctttctcgtcgaaaaaaaaacacccgcaggtgctttcatcataaaccaagagcattggttacagtttgtagccttgtacattctctgcctccagatgcagcacatcaatcatgctgactgcagctctgtatccgttgcgggcatgggaagctttatatagaaaactgtttcctccatattactgtccgcataaatgctgcctccgtgggcctcgacgatttcctttgcgattgcaagaccaagaccggctccaccggatgctgtggatctggccttatccagtcggaagaatttttcgaaaatcatctccagcttctgttctggaatttcatccccctgattgtggaattccagcaggatatgctctgcttcctgtttgactgctacccgtatcacggtattgggatagctataggaaatagcgtttttcaatacattattgaaagctctggcaagcttatccgcatcaccgtagcaaacagagccctctgcaatatccagcttcagctccttatgctgtgcaagcagagtcggatagaactgctcctttagctgttccagcagaaaatccaacgcaatcctccctcttgaaacaacgatatcatgaagattaaagcgcgttatatcaaaaaattcatcaatcagctgttccagtcgttccgccttatcaagggtgatacggatgtaggtatcccgctgtgcttttggaacatccgatacatcgttcaataggttcagatacccgatgactgaagccagcggtgtcttcatgtcatgggccagatacgatatcaaatcatgcttctgacgtgtctgtttctccagcattgccagctgcttctgttcctttgctcgaatctgcagcagaagtgcctctatattaccaaagccctccggaagataaaaatcgcgatcctccaaaaactgatgcagggccgtttccatcgccttttctatctctgccctgtgcttcatagcgacacggctgctttgtgtccgcacgcagacaatacaaattacaacaaccagtgccgtcagcaaaaaaaacagctgcttgattcgataccagttgggagaaagatactgatgcaggatacctgtcgtatccgtatattcttccatatagaaaaactgttcggacaaaaattcccgcagcataccgttgcccagcagatccgcagcgatataaactccagcgaccactgcgattgctgcaagcagtatccatacagtgcgtttcatagtgtttctcccagcttatagcccacaccccagacactttgtatatagcgcgggtgttctccgcgatccttcatcttttcacggatatgccggatatgtaccatcagggtattgttgctggatgagagatattcttcctgccagattgcggtgtacagctcccttgcactgacaacctttccctgacgctcacacagataccataaaagacgaaattcaatcggtgtaagattcaggtctttctcattcaacctgcatatatgctgttcctgattcatgacaagtcccagataacttagctcctttgccttctgctgaacattatagcgcttgtatcttctaagctgcgccttgacgcgggcaatcagctccagcggctgaaacggcttagtcatataatcatcagccccgatcatcaatccattgattttatcaatatcctgctccttcgctgtcagcatgataatgggccatgtgtagttctgacgaatggtcctacaaatgctaaagccatccatatccggaagcatgacatccaatatggccagatcgtaggaacgtgtccgtatattctgcagagcctgtgtccctgtatagcatacatccaccttataattttcattttttaaataaatttccacaagcccggcaatttccttttcatcatccactaccagtatattcatgtccattcctcctgtacttctctgtcaatcatactgcttgcgtatgcatgatgctttccgcaatccttcacacacattataccagagcctatggaaagacttccttacatttcacttaattccaggaaacagtatatgcaaaccgtcaatatcattcacagaggctgaaatttcacaatatcttccagattctgcaggtattcttcaaataaaagagcacatgaaaagccgtatccagtacggcctttacagatgaccaagaatacggctttttcatgtaggatgctgtataattgtctttctccataccgcctttttcttgcaaagcaattatgaacgttgtaatactgtcagttacggtttttatgaaagagcaattgctggttaataggatgcagtatacgtaaaggtaaagtcatctccatccttaattttcagactgcttgcagcatcacagcttccggcagccttgcaggattcgttattctctgattcatacagccaccatggccccttattaaagtccttggtttccacacccttcatagccataatggtttttccatattgaccgtcttccattttcacacccagatccttcgccttctccagaaagtccgcaagtgtttccacctttccctctacacttacatttccgttaaacagctcctttttgttaacctcgtcctgaatcgtgattttcagcgttgttttttccgtgttgtcactaacaggctccttcttttcactttcctttgaagagcatccgccaacaagcagcatggcagataccaataaaattttacatagctttcccattttgcaatctcctttccatatggtttaaaaccgctgctatcggtttataacagatggcacaaagcgccatggacataaagccctgaataagagaggtctttaatcccataagaatataaatcgctgttatttttcccgaaatcagcataaagggcagctgtaccagctggcctgtcagaaatgacagaaagccgcaggtgaataccagcgcgaggaaatgtctgttcaggaatttcctgctgcagccgataaacagactgtacagcggataaatcagacagtacatcatcgaccatggggctaccccctgggtactcagattgagtatggtaaacaccactgcacccagaacagcctgccttgtctgaaatgtcatcgcaaataccacaatggtaaatgtaatgcattccagatatagaatgaatgaaaatgatgtaaacacgacagcttcaatcgaagcgataacggctatgaagcaaagctctcttgccttcatacataggacctgctaataaattctctttcccttataccgtcctgtgcattctcatacaggcacatcatgaaaaaggtattggatagcagattcataaaatcaaacaggatggcttccaccggctttccctcacactgaatctgatgcatgatgcggataacagccttgacttctgcacgcagcacatgcagatggctggcaccaatacagccgtcgggcaggacaaaacgatccatctcaatatggtaacgtgcatagaaggtattcagctttttcagttcagcctcccctatggcacacgctccccggatggatccattggcgtgatagatcatttccatcagttgaaggaggtcctcctgcggaatatgacggatgtggtgtcttgccacggatagtatggatgccagacgatccgttgctatctcataatcgcacaggtgacttttttccttcagaaaaggatatgcacaatattcaacactcattttttcaccctcactttcttaacgacagcgggcagaaaacatataaaaaaactatattctccacacccagcagaaaactctgtttgcataacaggcaagtctcccggcttaatttcatcctactcttcaccttctcataccagattggtacaatggtttctgaatttcgtccatatcacggttgctggggcagctgaagatgttcgcttccattccttgttcggtattttcatacacctgttatgctttttttcattcattcgctcttaattataaaggcaacgcgttcttctgtctatagtaaatactgctttccatcttcccattgttgtcatatctgtcagctgcctgagtttccggcaggtaagaaaaaacatccctgtttaagagatgcgatttcatctattcctcatcagcgtaaatcctgtaactatgcatgccctttttggagttatacatggaggtgtcgaccttttgaaacagctcctgataggtactgccgtgctccggaaaataagtgacaccaatgctgagcgtgatgtgctgtgtaaagggaaactgcctttgttcatcctcccagtgctcacgaaattgtgcgagaatgtgttccagcatgcagttgtccaaatgtcgggggcagtaaacaagaaattcatccccgccaatccttgacacgatatcctttgaaaaggttttttgcaaagcctgtgcaagcgtaattagaatccggtctcccacaggatgaccatatgtgtcattataaaatttaaagtggtcaacatccatcattagaattgttccctgcttcccgttacgcagttgttcttcaatctgtttttcgcagtaatagcgatttgtaagcttcgttaaataatcatgatgggagtaatataggactgccttgttgctttcctgcaattctcttgttttctgtgcgattttctcgcgcagctgctcattgctctgttcaatcaggcgcttaggaaaaaattcatcgctgcactggttgatatccggtacagactgatgtacatggagaagctcccagccggacggcgtatactgcaaaataatcgtaaaacgaaagtgcagctcataattgattcgatctcttgcatcctcattcacatcgagttctccgtataccatatatacattgtcacttaactgtctggcctggtatgcttcctgctcgatgacaaaggtgccgttccactgtttttcttctctctccagtaatacagcaaattcctgtaacgagtgtgaaacctcgtgcttaccggttcctatcacactgagttgcggactgaaatatccgccgggtatctcataggagcgttcctccagatactgatgccagagatgatggcagaactgctttgcatccgctgtatgattcataatatcatccttctttatttggttatctttattatacacattttccctatatccgtctccatattacaaaggtaaacttttataaaataatggaatccttatcaccacaggatcaaccgtattcgagaatggccatatatagcatcaggagaggcaaaaggacggatgaagccaaatctttgccacctttgttttcgtgtgatgcctgaaagccctcagggaacctgcagactattcagcgcttacggatgtcccttgggaacaagcaggtatgacagcattatactgatcatcacttatttgaaaaacaaatactgcccattcagaataaattacagcaaaaggcaaggtttttttcaattcattatatcagtataccgtcacaatgatccagctcgtgctgaataatctgtgcacaaaagccctcataggttttaattttctttttcccacagcaatccatgtaggataccttgattttctcatatcgtaaggctttcttctgtgtactatggcagagacatccttcctcggcagtatagcgcttatctccggtttttattatcacaggattcagcattgatacatagcttccgccatcctgaaatacgatgatacgtttcagaacacctatcatatttgctgccatcccgacacaatgatccgcatgtgcctgcaatgtatcctgcagatcctgaaccgtctgcagatcatccagcgtagcagcctcacaacgacggctgagcaaaaatgtatccttcacaatttccttgatcatatagtttcctccgatttcatttcagtttttcatccgtatgtattatcgcagaaacagcacacattggcaaatgcatcacaggtaaatgcaacaaaaaatagctgcatctttcaacatttgcataggaaagtgaataggtcttgtttcctggtagaaaaaacactaagatagagtgtagatacaagggaggcggcagtatgcagaatatgcagcattattatgatttttccggacagaaattcggatatcctctgagcttgagcattaacagttttaagcgacaggttttctccagacaatcgagtctggaaatttcgtatgtattaaagggtgcctacgaagcagttacagagcattttacagcaggtattaaggaacatgaactggtgattgttgcgccaaacgatattcacatgatccgacagatggataatgataaaagcgttatccttactttgcatattgatttttcccgattctctgcaggcatgtgcggaaatatagaggaagcctttgaatccatgatctgtacacgatcgaaaaattaccggctgctgtgcaggctgcgaaacaaaataggagaactggtccggatgctgctacggggagaaagcagtatgtttcagatgaacgccatcatgatggagcttgtctacattgccagcaatcatcggcagtatccggtagagcggcttcctctgcaatctgtccatcatgaaaactatatgaaggcgattcaatacattgactgccatttttcaagtgaactgcatttggaggatgtcgctaaaacactgtccttcagtgtttcctacacatcaaagctgtttaaaaaatataccggtatctcctttgtcaaatatctcgcatatgtcagaatccgggcttctttggaggccttgctggagggtaaggattccatagagcagatcgcggctgactgcggaatgccgaattccaaatcctatactgccgcattccgtgaattatacggcattgtacccagtgactatcgcaagaaattcacacaaaacattaaaatgaatgaaaatcataaagaacagagtatgagctttgatattgaacaaaaagaactactggagcatcttatagcagatacacaggaggttttatatgaaaatgacggtataaaaatcacgcagcaggaaggtcatatccaatgccgaattcagcatgagctgattacaaaaacaacaataacacagacagatgaggagcttgtaatggaggttattcgcaaatagctttccagcagcctcctttttttgtctttttctaactcatcaaatgtaaaaacacaacaaaatatgccggatatcatcaatgcatggcagcgattactattctgattcgtgataaaatatcagtaaaggagatgttaaaatgaacacctatcatcatttattttcaccaattaaagtagggcatacaaccatcaaaaatcgtgtgtttatgcctccgatttctacaaatctggcagataagggctatattacggatgagcttatacagcattatgaggccagagccaagggaggtgtcggactgattgttaccgaggtgacaactgtggagcctacctacatctatctgcccggggatatgtcgattcacgatgattcctttatccccgggtggaagaagctaacagatgcagtgcatcagtatggtgccaagatccttccacagctgtttcaccctgcctatatggcattccctattccaggcacaccacgtctgattgccccttccaatgtgggaccttcctatgcaaaagaagctccccgtccggttacaattgaagagctgaaggttatcatacgccagtttggagaagcagcccttcgtgttaagcaggcagggggtgacggtgtggaaattcacgctgcacatgcgcatggtcttcttggcggttttctgacaccgctttacaacaaacgctgtgatgaatatgggggagatatcaatggaagattgaagcttacactggaggttgttgaagaagttcggagtgtatgcggccctgatttcatcatcgatgtgagaatctcgggagatgaatatagtgatggcggattgaacctcgatgatatgatttatgtttccaagcagctggagacacatggggcagatatgctgcatgtatccggcggcactaccattaagcgcggcagtgcaattcctgcggcagggacaaagcctggagtgcatgctcatctgtctcaggaaataaaaaaacacgtaaatattccagtcgcaacagtaggtcggattacagaaccctggattgcggatgagctcatagccaatggaaaagcagatatatgcatgatcggtcgtgccaacctgtgtgatcctgattttgccaataaagcaaaatgcggaaaggacgatgatatccgtccgtgcattggctgtctgcgctgtttaaatggaattatgtttggcaaacgggtagcctgtacggtaaatccatcctttgagctggaaaatgaagacacgcttaagcctgccgaggttaagaaaaaaattctggtcattggtggagggcctgctggtatggaggcagcttttgtggcgaaaagaaaaggtcatcatgtcattctgtgtgaacaaagtgatgcgctgggaggattgatgaagctggcagcagtacctattgccaagcaggatctcagcagagttattaaatatatggcacgccgccttatgcaggcaggtgttgaagtacgcctgaattgcaaagttgagaaagcaatgctgcaaggagaatttgctgattatgaggtgattgcctccaatggtgccgttccatcaattataaaagcctttaccgggttcaagcagtgggctaccgccgatgatattctggcaggaaacgcattccccggtaaaaacattgtcatcctgggaggcggctctgtaggatgtgaaaccactgattatcttgctcccctagtttatgaccgttatccaagagatcgggtgataactgttttggaaatgacgaaagatatcatggtagctgaatccggtcccggccgcagtctgctcgtacagcgtatgctgaaaaagcatgtaaatctgatttgtgaagccacggtggaaaaggttgaaaaggataaaatttattatacaaaaaatggtaggacggaatgcatagatgatgctgatacactgatttttgcagttggctaccatagtgatccaaccttgaagcttctgttagaggaatgcggtatgacctatcacatgattggagatgcaaatcatacagggaccatcaaggatgctattcatgatggctatgaaacagcacgcagcatctgacatcaaggaatatcagtagcctgaatagctttgagacattggagttgcttctgacatcgtttatagtttgttattttcgatacgtacaaaagactgcccgcaccaaatcaattctgatttctgtgtacagtcttttttctacctgtatccacgctaaatttttttatttccacttctgcatttgtaatcaggaaaccttttcattgaataatcgtttatatatccattctgaatgaaatcattttcaaatcctttgcctcttttactccagcatattccagctgactgcgaacctcttccagtacaagatagaacagatatttcatctcactcacatataactgctcatcccttgttttcatggcatatcgaagcacatcaaaggtatgacaaaatatcgactgatatctctctttatccaaatggcaaataaacggataaacccatagaatatgctgttttagctcttcaaaaatgctctttaggctttcctgcttatttacatccatgatagaatcacaatactcacaaattagtctcacccaatttatacttgtgatttctgtatttgataatgcttgttggagttgttcatggcgttgcaccatacttgtaaaagacatagtggtaaatgcctggcaagttaactgtaaaatctgaagacactgcataccttcaatcacacgttctctgacaccgttgtcttccagcatctcatgaattctgttttcctcacattgaattactttcattcccttaccgccaataggctgtataacaccggtcgcctgaagaattgacatagcccgtcgcagagtcggttcactcacctgataaatctcgcaaagatccaaaacccgtggaaggcgactctctaccggatatatctggtaaatgatatccttcaataaactgcttgcaatattataaatctgccgtggccgtccacgatatatattccagcgaaagcttaccttacgctcaggttttcgctgtggaagcttagcatagcactcctgtgtttttctggaatcatccacaaagtattttttcgttatttcatatatatcctgatgagtcagctgcttttgatgtattgcatcaataaatgcgtgtaccttcgtagtatcactatgcgcacgaattccctgcaacaccatagaatcctttattttttcataaaaagacagtcttccaaatattgcgacctccatataaagacagcaaaccagcggatttccaaatacagagaggaccgtttccacaaacgccacgactgtacgttcaccctgcatctgatcaatacttttatgaattgcggcatattgttcctctttaagcaaacacaaagcctgggtaaacaaatcaggaagcaaaatattgcgtacctcacacaaatcctgtactgcatattttctttccagaaaaaactgaatgcagttctctctacactcctcttcgttaagtcccagtgtaagacgtgaatgcctgccacgtgacatctctatgtagtgatgttcctccaggagcttaaaggcatgaatgacgggacgcctggaaacctgaaatcgttcagcaaactgtgaaatagttgggagcttttctccctgacggaaaatcccaaagcggattgcttcttcaatataattatagatccactcatgcagactcatttcttctttcatccaatcatcctccttaacgcttattcatcctcatcttatcacaccatttaccttgcaacaaatgcttttatgaaaaaatcagctgtttagcgctcggcatgtatgccttgcagctccttcagttacaaggatacgaattttaaaaaatgaatatatgtttatgactccgttcgcaggttagtaatgatatcattcttacaaacactcatataaaaaaactatggagatatttatcaagacttactttgcagactcctcaacacctcttgattcctagaaattttctgaaattttataggctcctttgtaggcttatgatatccctgcaattgcctgttattagaatttaatcaaaaattcctgctcgataaccattatgatgaatttgcactctcaaccgatatatgctcaatctgtgaaggaaaagcagaagaaataagaatctgctgcagagattatttgtgcttcagtgtataaatttcctgcctctgcacatgtttgctgaaaagagattatataggcatgtctgaaaccgctcatttatcttttagaaacagctcaacgtgatttctttttaaaacagcagctgccatttcagttctttcttacttctgggtggcaaagtggatgtttcaaattcattgatgcattagagttgaattatcctttatttcttaccgttgagtaatccccttagtcccaactaatattttttagattctccgcctgaatttcaatgatatcacgaatgtgtatcaccttatccacaatctgaataatgtgcaaatattcaggatcaaatttagacaccaacccttccacttctacatattcctgctgatcataataaacaattttaaccatttgacccttttgaatctgctgtaatttacgatccaatacctcacaggcatccgaagaaagctgctttttgtcaactaccacgcgttccttacatttcaagtaatcacgaaagcctttcaaagaatcaaaaggcaaaaataatttcgcacgactcgtatgattctgtttattctgcattgtgaccacctacaagcttattgcgagatattgcagttgccttattcaggagattcatcccctttatcacagcattttttccgaatttgtgtttgatattaagtaaagtaagctgtagtttcttctctttttccagagcattgaaatctgtgaataaatcatatgtctcatacatttcatcaactacatttccaaagctgatagacagcatatgtaccagctcctgacgatttactgtttccctatacagttcaataaatgcattacgcagatatgcatacgagttagttacattggataattttctggagcctccggttgcctttacatttcttgctgagtaaccgatatacagaccgatatgatccgttacccagtgagattccacaagattctgtacatttagctcaaccatctccttcaggaccagcaatgcctcttcataattataatcctcaaataaaatctgactgtttgacaatgagttgctttttgatttatatgcctttatttccttgatggtcgtcggttccctgccccatgcatgatcgatcagatattctgcattcacaccaaactcccgatagagaattcgctcatccatatgtgcaatatcatacatatcagccacactgtacttttccagcctcttggaaattccacgtccaacctgccaaaagtcagatacaggcttatgatgccaaagcgtctctctatacaattgctcgtcaagtatccccatgttatccttcgcatgcttagcagttatatccaatgcaattttagcaaggtaaagatttgtaccaatacctactgttgccgtgataccggttgttgtgtagatatcctgcaatatcatacgggcaagctcctttgcactgacactgtacatctgcagatattcgctaacatccagaaatgcttcatctatagaatacacatgaatatcctctctggatatatattttaagtatatcccataaatatcagcagaatactgcatatacaaattcattcgcggcatggcagtgatataggagatattatccggtatttcaaaaattctgcaccggttatgaactccctgttctttcattttcggtgatactgccagacagagcgcacctttacctctggaggggtctgcgacaaccagattaactgcaaacggatcgagcttgcgctccacacattcaacagaagcaaagaatgtttttaaatcaatgcatagataagccttcatcatatctccacctcttcatctgcgattatactaccataagttgcatttatcaatataaaatgcaactttttaatgcaaattttttattttttaagaatttaatgaaattttttgcaacttttgttattctaatttataatgatgaaaagaggtgagtcattatgcagctaaaagatttattaaatgaatataaatgccggatgagtgttaccaatgactatatagcagagcatgtcggcgtcaataaatcaacggtttcacggtggatgaagggtgagactaaggtcatgaagcctgctgttattgaaaagctttcttatctgctggggacagatgtagaatccttattaaagaattctgacagatttgaaaagccgctgcttggaacagcaaaggccggatatggattatttgcagaagaaaacttggcaggctatgaggaggtatcaaagagcgattattatcggggcgattattttcttcgcgtctgcggtgactccatgacaggtgctcatatacatgatcaggatcttatctatgtaaagcagtgtgatgatgtaaaaagtggtactatcgctgttatcctgattggaaatacagaggtgaccgtaaaacgcattataaaaaaagaacctttcctcattctggaggcagccaatcccacagtgcctgcccgctactttacgcaggaggaagtgagagatctccctgtaaaaattattggaaaagttctttacagccgctctgatatcgcctgattgaaaagtatttcaatgcattcgaggcagtgtggttttttctgccttatcttcgtttatatatcaaatctgtaatgccgttatacgatttagaggcagcaagctttaatttcaaaattgtttttcgcccttgaaataatggtataccgctgcctaatataatcggaatcacagagatatgataagtatcaattatattctgttcaattaagggctgaataatatctgcaccaccgcatatccaaatatcttttccttcctgccttttcatatgcagtatactttcacatatgtctccctgaatgaaatggatattttccttaccgatcaatttccgatgtgtaaatatatagctttccaaatgttcataaagccaacgttctggtgaaagctccgtaattatttgatgataggtattccagcccattatcacggtatccacatcctgtatgaattcctgataagacaccatatcatcctgttcagtttcctgtccctgcagccagtcaacagatccatccttttttgctatatatccatcaagactcatcgctataaacaacgttacatttctcatagtatctcttctcctttgcatcagcataacataatactatcattctgtaacaggagtatgcccttttgataatcaattatacaagagatatgtttatccaatagctgcctcataatggaaaagagtgcattacaatgccagcgatttgctacagctgcatttcaggatgtcgtttctgaatatacagaaaagcaaaaacagacagaatggcgtcatcatccactctatctgtttgctataatctgtaatgtaattcacacatttacggctatccaaattttttaggggttttcgccagaaatttgggggtcaactttgggggagagaaaaaataaaggctaaaaattaagacccctaaagttaaaatcaagagaatcagtgaaaaaacattctgattctctttttttggttatgcttctgtacaaattcttaatctctttattcttttactttatatttaccacgtttctttccaacatagctatgtacttcattagatgatttgggcgtatttctcaatgcaggtctatttctggtagaccataagattcgatttctagtataattaaaattagaggaacctcgtgagtttctcttataatctttcggctttcggttgaatgattccataggtccattggataaacgtgcatagtaacgctcattatcctttgcactacgtcttgatacctcagttatagtaaatgagcgggcaatctcatgcttatatttatcaaggtattgtgagaaaagacaaggaatgtaacctctgagagccttaaattcttcaatcatttttaataattcttgcattacttcatcttcagaactaaagtgagtattattgaatctaatatatttttctttcacatctctgattatattgaacttaggatctagtgagagaaatagtttttcaatagtatatgtatctgcgtacattctaagagagctgtggtaataccttttgtcagagtaattgatattgtcttgattcttcaaaagcacccagcgatattttctaagcaagataacttcttgtgattcctgaatcgttttattgtctctattggtgtcatgattttgtttttcaagccttttaagatctctatctttatatgctttcattactgaattgatataagtattaatcaatcctaataaatatttaacaacatgaaaactatctaaaatcgacacagcatttggaaagaaatgcttgggtaattcaagataaggcttatatgcatcagaaataatataacgaacatgttttctttcttcgtatggaatggagaagaagtagttttcaatggtatgatgccatcggttatgcaagatgtcaacaatctctccagaagtaaagtccataagaatcaaggcatatttctctttttcagaaatatcaatatgtacttcatcaacggaaagaaactcaggaagagttaaacgtggcaaatccacgtaagcagtgaaaagatcgtgaacttgagtatcagataaattgaattgtctggcaatagatgcggtagaacgatcaaggtctttcatagcctctaaaactagtagaggagtaatatcagaggattgtttataacgctgaaagaatgggaaatcttcattaacatatgtggaacagttagtgcatttccactttctttggctcacgataaagatgatgcaagttccgtcttgtaagacagggtgtttgattttgcgcttataaataccttttgagtgcattctgcaagaacaattagggcaataagacgggatagatggtcgagagatatatacatacttggtatcagcgatgatttcaacatcgttgatgataatagaaccatcatcgggaatgtttaataatttaaatagataagaatgatccatgattacctccttcacagaagcataaccaatagaacattatagaaaaagaaacagatgaatgccacctgtttcttttgggatttatccccctaaagtgtccctcaaagttcagacccctaaattgacccctaaagtttagccccccaaatattttggatacccacatttacttggtgtgtatcagctttcattaaggaaataatgtccataagcatctgccgcgataatagccgcatacaccttatccggagtgacctcaaacggcatgttatgcagtgtatcattttccgcacatgctgccttcgctactgccattattttctcttttgtgatttcagcagcaccaagctcctccagtgtaacaggtaatccaagctcaatacagaattctatgatttcctgcagctcagcagtttcaacgttttctaaaaccagctgtgcaatggtgccaaatgcaaccttctcgccatgatacatatggtggcattcctccaatacagtcagaccattatgaatcgcatgagctcctgcaagaccagcgctctcgaagccaatgccgctaagcagcgtattagcctctataatcttttcaacagcaggagtacacacgcccgcttccaaagcaagcttcgccttcacaccttcctccattaaagtttcaaagcacagctttgcaagtaccatagcagctccggtaaccttaccgcctgcgcagctcaccgcatcactctgctcacatgcccgcgcttcaaaataggttgcaagagcatcacccatcccagctacagtaagtcttacaggagattttgcaatgatatctgtatccatcaggaccagattcggattagcaggtaaaaagagatattcttcaaaaaccccttcatctgtatagattacggaaagtgcactgcatggagcatctgttgacgctatggttggacaaatcaaaacagcagttttttcataatgtgcaaccgccttggctgtatcaaagatttttcctccaccgatacctatcacaagattacatgtgtttttcttcataactccacgtaaccgctctatttcatgttttgaacattctccatgaaaataatcaaaaataaacgtacagcctgttccagcaaagctgttttcaatatcctttccaattctgcgatatccgccctcactgatcaaaatcagtgctttcgttccatacccttctgcgtatactcccagttttttcatttcaccagcaccctgtacatattttccagggctaattaaaacctttgccatgttaccaccatccttttctatggcaattcatttctttatatattgtaagatagcgttttcacaaagtcaatgaatcttctgtaaaaacattggccctatctgttttcacaagacatgctgatcgaacaggtattccagtctcattataaaaatcagacagtttcatataaaagcaatatgtaaatgatgtcttgcatcttcatttgtcattatccgtaaatgaacatcaatgtaatacggttaagcaatttgtctcatagtaaaatcatcaagctacagatgatatcgtcttaaaattacgagaaggcacagctatatgaaatcatgctataagatgttatctgcttcaaaaacagaataaccctattgactctaccattaggggagactatataatgagtattgatatttatcatgaactagcaaaggagttataaatgaaaaaacaagacagcatagtgattcgaggactgaatcaaaataacctgaagcatgtatctcttaccatacctaaagacaaaattgttgtattcacgggagtatccggctctggaaaatccagcattgtatttgatacaattgctgcagagagtcaacgccagatgaacgagacttatactgctttcatacgaggacgccttcctaaattcgaaaagcctaaagtagatcacatcgatcatttgagtgcctcagttattatcgatcaaagcagactacaggggaatgccagatcaaccgttggcaccatcagtgatctttactctgctatgcgactgctattctcgcgaataggctccccctatataggaagcgcctcctgtttctccttcaacgatccaagtggaatgtgtccggagtgctcagggcttggaaaagttattgaactggatatatgtaaagcactagatcccgagaaatcatggaaggagggaatggtcgatcttcctgccttccatcctggtaactggtattatcgacagtacacagaatccggtttgtttgatcttgaaaagccgcttaaaaattatagcgaacaggaatacaatcttcttttatacggagcctacaaacgtggagacaaacggttgaataaacgtgttgaaggtattcacaatcatttttcaagacttcttatcaaccgggaccattcgggctcctctgaggtttcaaaaaaacgtttagaagagatgatacaggaaaaagaatgcccactttgtcatggtaagcgattaaatgagcatgctttgtcctgtaaaatcaacggatttacaattgctgatctttgtaacatggagtttctgaagttacgggatgttatcagtggaataaaggatgcaagagtaaccacaatcatagaggctctaacagcatctctgagccgtatgattgatatcgggcttccgtatctgagcatgaacagagaatcctccacactatcagggggtgaagcacagagactgaagctggtccgttatatggggagctccttgacaggtttaacctatatatttgatgaaccaagcacaggcatgcatccaagagatgtatacagaatgacagatttgcttcgcaagctgagagatagaggaaatacagttctggtagtagaacacgataaggatgtcatcagaatagcagatgaaataatagatgtaggcccactggcaggaagaaatggcgggaggattatgtttcagggaagctatgagcagcttttatgttcagatacacgaaccggtcatgcaatgcgtgagcaaatcaggataaaaaatcagcccagaatcccaactgaatatctttccataaataacgcatcactacacaatctgaagcatgtctctgtggatattcctctgcatattcttacagtggtgagcggcgtggcaggttcaggaaaaagctctcttatccgtgatgtctttgcaaagcaatacgaagaccgtgtagtcctcgtggatcagacgccaataactgcaaccggccggtctacaccggcaaccttcctggatttcagtaatgatatcagaaagctgatggcaaatgaacatcacattgatgtcggtatgttttccttcaacagcaaaggagcatgtccgcattgccatggaaagggaattgttgttacagagctcgtatttatggaccctgtaacaaccgtatgcgaaatgtgcgaaggaaaacgctacagcgaggaggcattatcttatgagtaccgtggacataacatagccgacattatggaattaaccgttgaagatgcattggaattcttcaatgacaagccaaagattttcagaaaactgcgcaccctgcacgaggtaggtttatcctatctgtcactcggacaaccactttcaacactttccggtggtgagcgtcagagaattaagcttgcaaagcatcttaaaaataaaggaaatatttttatactggatgagccaactactggtcttcatgcatccgatatcaaaagtatcatgaaactgctggaaggctttgtagaacgaggtaatacagttatcattatcgagcataatctggatgtgatgaagcaggcagattatatcatagatatcggaccggatggcggtactgcaggtggagaggttgttttcatggggacaccaaagcaaatgcttgaacaggctgacactataactgcacactatttaagaaaatcctgttatgaagtaacacagcaatagcctttcgaatgtacaaagcaagagcaagcgtcaaacacggtaaaatagagaaaacaaccttctttttcagaatccccttttgcattgattacatacaaacagccataagcatggagaaacctcttggtaaccaagcagaatacctatgatacttaagaaaagcgacataacatagactggaggtgaagaatatgctgaagatgctggaggatactgggattacaggtcctaccgggcctacaggtcccactggaccgacaggtccgcgaggtattacaggaagcacaggagcaaacggcgctacaggtatcagtggtgcgacggggcctactggtgctaatggaagtacaggtcctaccggagcacgaggtgcaacaggaccaaatggtgcaacgggcgaaacaggaccgaaaggcacaaccggtgcgacagggttaacaggagcgacaggaatcagcggtgcgacggggcctactggcgcgaacggaacagcaggaccaacaggttccagaggcaatacagggccaacaggagcaactggaaataccggtatacagggagctaccggagctacgggagagaatggagcaacgggggctacaggggcaagtggtgaacctggtttaccaggagcgagcggacctacaggtgcaaccggaaacacaggaccgactggaagtgatggagcgacaggtgcaaccggagaaaccggggcagcaggcagcacaggcgcgacaggcgcaacgggcgcggatggcgttagcgggcccacaggggcaaccggcaatacaggtcctactggggccattggtgttacaggaccgattggagcaaccggacaaaacggagaagcaggaccgacaggtcctgctggcaataccggagttacgggtgccaccggggatacaggtcctacgggaaataccggagcgactggcaatgatggaaatactggagcaaccggagcgaccggcaatacaggagctgatggcatacagggatctacaggtcccatcgggcccacaggttcaaccggagcaactggaataaccggagcgaccgggataagtggtataacaggcgcagacggagctacaggtcctaccggggccacaggcagcacaggcgcgaacggcatcacaggaccgacaggtgcaaccggcagcacgggagctacaggactttccggcatacagggtgccacaggagcgaccggtaataccggagccaatggaagcacgggaccgactggtccaacgggagctacaggcgctatcggtaataccggggcaactggtactaacggagtcacaggcgcaaccggaccacagggtaataccggtgtaaccggagccaatggaattaccggaccaacaggagcaaccggtagcacgggagcgaccgcaacagcgcaaaatggacaattttctgtcaatgcatcgtccatatccagcaactctctcattacattttctactgcatttatcaacggaacaactatttcagcagcaagtacaaccgcaatcaatctgagtgccggacatgtctatcaggtttcttttttggtaaaagcatctgtaactgtagcaggtgcaatcggtgttacacctcagctaaacggtgtttcccaaacaggctttgcgacaagtgccaacgctgcattaacggcaccaacagtaagtgtcagcggaacatttcttgtaaatacgctgattagtgcagatgttcaggtctctttcctatatacatcttcactgcttgcaaactctccatctggtgtcttcagtattttacagatacagtagctttaccaaattcattgctattataaaactcccggacactgtgcatgttgacagcaatccgggagtatttatacagtaaataaatttacaatgaaaacaggtgtgccaaaatcgcgataacctcgcccagcatggttgacataatcagcataggtagtccagatttcttgtcctccttggatacgatgataatcatgggaagagccagtattccgccaatcagccctccctttatccaccataccacatgaaacaactctgtattcaatatgataaacggcaaggtgaaataaaatacaaatgccgatgctattgaatacttatccagcttcattttcaccatgggcagaatatctactgccccgactgcaatacctaacatacaggttataaaaaatttgtccatacatcctccttattttcctacatcttattagacggtaaatttcttttattgtgacagtctttcatcaatttatttcaccggcttcagaattttcattttacttattcagcaattatgaaaaaggatgaaaaagtcagaatctttcacacaggaaaaggttcctgttctattgtgttttcaatagatcagaaacctttttcctgccctacttatggtttcagacaaatcaaattgctgctctttacttatctctcactgctttgagaagctcatcctttttctccagaatataggcagccgctgtacatgcaggacaatcgcagtatagcgctccctgctgtttgatttcctttgcatgctccgctacctgaactgccttctcttcaccaaatatctgctttccctgatttgattctgccagcgcaatcaaatcctgaatagtgacaatatcttcctccagttctttcatatacgcctgagttacctcctcaatgcgctgtgtgcctaccgcatcaagccatgtctgagccgcagcccttgcttctgcactgcaagtaacagaattcataagctcctttgttttttctgtgatagcattcatcaattcttgtttcataacaataccctctttcctatgtataccttcattatacatgcttcctttgcgaatgtcattttccaagtttaaaaatctaattattctgtcaggcttcttctataagaatacctcaccatatatagaacccgccacttttcaaataaggccaaagtcattgttctgcatataaattaaccgttgtaatgagaacacacacattggcatgaaaacttacgtgctcctgcgaacttccacagatagcatccctgtaaggtcctttcatttttttaattctaattctacatcactaacataaaacgatagtaatctaaccgtatcgatctgtattcaatagttcgcattctaaaaaaattatgttataatacttccatgtcaaattttaaactcaggcttttaatctatttcgcaacgatttctgcgagtacgctgttaatttcaaatttagcagcagtaaagctatggaatttttttggtattgcagttgatggaggtgtcgtagtatttccgatcacttatattatcggagatttgattgttgaattttatggaaaaaagattgccaaaaatattattctagctggtttctttattaatatacttgcgattatcgtgttttatatagtaatcgcgcttcctccttatgaaggatggacaatgcaagctgctatggcaagtgttttgggatttactccccgcattattatcggttcgctgacagcatatgtttgttcaaatttcctgaacaattatatattcacaagattaaaaaacggaaacggatttttcgcttccagctttatcgcgcgtgcgctgggctcttcagcctttgcgcatattattgattgtgtcatatttgagacaattgcatttatcggcgtccttacttttcaggagtttcttgcacaggcagtattcgcctatgttctgggaatcggctttgaaattgtattctcaccgatagaagcattcatagcaaacttattaagaggtaagataacagatgacaaactataaaaataacaatacattcagctttgaaataataaagcggataccaggcaagcttggccgtgccggtattattcatacaccccatggggatatcaagacaccggcatttatgagtgttggtacaaagggtgaagtgaaatttgtatctatggaggatttgtacctgatacaggcgcaggctatgctgagtaacggataccacttgcgtaatgcctcctttgaaattgctgaaaacggcggacttgcgtcatggtccggctggaacggacctacactgacagattccggaggttttcaggttatgtctctgggatccggtatgggaaaagtagtcagtatgaagcgggaaaatgatgtcataaacacagatcccaaagatcgacttgcacatgttacagaggatggtgtcagattccatgacccgtttacagatcaggaggattttatcggacctgaggaatccatgcaaatccaatgccgaatcggtgctgatattcatatggcctatgatgagctgacatcccttgcggacagttatgaatataatgttgaggctttggcccgtacagagcgctgggcaatccgtagtataaatgaacacaaaaagcactgtgatgatcttggatatcatcagtcactttatggtgttctacagggtggacgctgggaggacctgcgccgctcaaccgctaaaagatttgctgaaatggattttgatggttatggtctcggcggtgcttttctaaaggaaagccttggtgacatattgcgctggtgctgtgaagagcttccggaaaccaagccgcggcatctgcttggtctttcccatcctgacgatattctgattggtacagaaatgggtgcagatacctttgattgtgttgcgccaacccgtgaagcaaggcatggaaagctgtatacaaagcatggccctatcaagctgtcaaagtttacagacagtccgcttctgctggatgagaactgtgactgcccaacctgtcaagccggatggacgcgcggagagcttcgtgcattgtggaaatccggaagcacagagggtaagcacaaatatttcaaccttgctactctgcataatctacgctttattattcgccttacagagaatacaagacaggcaattctggaggatcggtttgcggaattcaaggaagctttcttaaaatgctattatccgcaaagcgaaaaataaacgaaaaggactatatgcgaatcattaatgagaccgtatataatccttttttttctgctctgaaaactcaaatatgcaggcgtctgtatttctactgcactactcataaagccacatattgtttctacaattcatgtatacagcatgcttgtaagcttactcccaatataacaatagctttaataaatgcttgattgtatccgtcatcacctcatccgtatacagaaagcttttctgaaccttacgcatacataaacacatgtgtgtcggcttaaagcagtagcagccagttagaccatagcatagattatctctccaaagcaattactttaggtgaacctactgtaagttctataagggcatacagcattggtagtatataatccagatacactgtcatttcgcagtctccagaggaaatctgtcaatcacagagctgtaccttttttcggaataaacagcctcttcatatctgccccctccagtgtaagcaatttgattttcacatcaattcctcctgcatagccagttaagctgccgtttgtgccaactacacgatgacatgggatgataatggatatcgggttatgaccaacagcaccgccgactgcctgtgcagacatcttcggctgacctgtgacaactgccatttttcttgcaatatccccataggtcaccacctctccgtacggaatctgacataaaagcttccacacattctgtcgaaattctccaccttttggtaaaagcggaagattctcaatcaaaggtctttcacccgcaaagtatttatccagccaagctttagcggataggaaaacaggaatattctccctcgtgatgcatttttcagtcagtgtgccgccataatatttctgaccctctaaccataaaccgattatgttatcaccatctgaagccaatgttatttttccaacgggcgaaaaataagtcgctttgtaaagcataagagtcctcccttcttataattaccacaccattcacagacaggcatatgcgaaaagcacatttttatatgtgtgaatccattcccctatataactgctttcattgtatcgccacataaatatcgatttctgtatccgcatcagcataaccgtgaaaccgctcatcatacagctcaaaagaatctctggaagcaagcacctcttttgttgaaagaatccatgttccccagatataattaattgtctgtgacagcgtttgtaaaccaccatgatgggtaaatactgcataacgtcctttttgaatcttacggcgcacaaaagtgtccgaaatcatatctgcggcattcatctcgaaccccaatacctcatgaaactgcatatcctcatgaatcatgtaatgggtcagattgtcacaggattcataaacgccaaatcttctgcgatttctgtattgctccggaagcagcttgtaaaatgcttcccaatgctccttcagctcatcctgatgcagtgatacttcgttacggatacctgcaatttcaatttcaggaagctcaacaaattttggatgaacatttatatgctccatcagatgtgttattttttcatcattcagacgctgctttcctgaggcaaatgtatgaatacgattgcttcgatatgttgatggattcactttatatacacttttaaatgcacggctgaaagcttcagctgattcaaaattattatcaagcgcaatcgtaataatcttttcatctgtgtaaagaagcttttgcgcagcatttgccaatctgcgcttcttaatataatttcctatactttctcctaataccgcaataaactgacgattcaaatgataataggaataaccggtaaccttagagacctcttctacactcaacgcttcatttaaatgctgctctatataaatcactgcctgctccagcacttttttatagtccataagctgctcctttacagaggaatccattcaaatatatccttctaatctgtttcaacagcaagagcaatgtccctttgctcctcctgtatatcatctaaagaatagcatctccaagtatttcttgcaagaccaccccagcataattcaatagtagctgaagtgaaaagttaaattccactttcaaagtagctaagtagaaaagactcttacacaacaatctagttgaatttacacttacaattgcatttagtctttcatatatccttttttatatctatgatgaaggtaaccgctggttattatcatacacattacaaagggtgatgaatatggcaacgaacaaaaacaaacatctgactcaggacgatcgcaatgtcatcgcgatcggcatcgttaatggttcttctaaaaaagctattgctgataatctaggcaaagataaatctacgataggtaaggaaatccgtgctcaccgttatctctctcataaatctacactttctctagaatgcgagaactatgctcactgtaagtttaagagaaagaattgtactgtcaactgccctgattattctaagttccgctgtaaacgcagagatcgtactccgggagcttgtaatggctgtgagaaactgaaaagctgccgctttgataaatacctctataaacctacgatcgcctatgaggaataccgtagcgaactcgttgagtctcgaaccggaatcaatctgacctcatcagaagctgtagagctaggcaataccatcaagcctcttctattaaaaggtcattcaccttatcagatcatagctgcacatcccgaacttggaatcagtgagaagacactctacaactatattgaacaaggtgtattcgaatgtgttggcattgctaatattgaccttcgtataaaagtcaaaagaaaaatgaccgctaagaagaagacgatctataaaaaacgacaagaccgtaaattccttgttggacggctttacacagattaccaatcctatgttgagtctgaggaaatcacacacattttacaaatggatacagtctataatgacatttccaatggaccgtttatccagactttcaaattcatcaaatatgggctcctgtttgctgtatatcacgacacgaagactgctgcagatatggttgacggactagctgttcttgattccatccttggaaaaagcctgtttgaacaggaagctcatataacactcactgatcgcggaggtgaatttactgatgctgagcatatggaaaaaagagacgatggtaccagaaggacacgagtcttctattgcgaccctatgcagtccgggcagaaaggaagcctggaaaatatgcatcgtgaattacgttatatattacctaacgaagtagacttacgcagtatcggcctgaccgatcagacttccttgaatgtagccatctcacatatcaattccagtgccaaggaacatttgaatggaaaatccccatttgagctatgtgagttcatgtgtccggaattagcgcagaaactttatgaatttggtctacagaaaatagaaaaggacgaagtgatacttcgtccaagcgtattgactcataagtaacaaacagatgatataaagaatgataagagcagcgggaagaacagttatttatagtgtaactataaaatggaagtggaatttagttatacataggcataatggagcctattttcagtgcgcttatccattttatctatcattcgcacaatgaccactttcttcacatttttacttacttctacctatttgaaaccctttctaacgctatatttatgctctgtatagacttttgtagaagaaagttccacattttttattcgccttttgaaagtggaatttaacttttcacttcagctaattcaatagtattgtcaaaaggggacaagatcatacttttagttgtgccaaagctttccctgtagtgatgaaagcacaacccctcaggataatcggataacagcatttcctttaaggtatttcgtgtgatatccgttttattggataatttcccttcgatatattgataccgtcgcacgctgtgcttaaaggcaccagattccaaatgcttataatcgtctaaaaccgcatgatttgttgtgaatagcagtgcttcctcagtcgtgatgcagcgaatcgccttcataccggcataggtttgaatcagagcggcatgttcttccttgtcaaaaataatcatattcatgtgaaaggcaattggcatatcctttatatacgataatgcttcctgcacattacggcagttttccaaaagagctctaacaacaatccagtattgcagtccctctatacagggcgttttcatatatggcaaatccacaactggcataccacaggaggtcatggtgacagcaagaccatattcatttatgccatcatctcgcccggcggccagaatagaggttcccatatgcgtgtattttcccgtaacagaggtttttatcaaagtgaaatcctcaatttcatcggagaactcaaaattgcgtgcaagtagaggctttttttcctttgtgattgagaaacataccgcgatttgtgaacaattcggtaccagatgtgtcatatgatagaaatataaatccttgggctcaacatgaagtgcatctgcaattcctttcaattcatcacataatcccggacaccagatatccaatagactatttattttttctaatctattctgattcattttgttattgtgagatacacactttctccgccaaacagtgtctttagaaattacgtctccaagacgaaatccgatttcatagcttgaaccggttagatataaggtgcgtgctgttgcttttgtatacttcatagaatcccttccttttcagaactttcttataggaatagtttagcagtattcttatttttatgcatgatattttatgctattcttcgtttaaaggtattccttgatttgtgatgattagcaactgcgttttttaagatggaacgagctaatgatgaggctactgcataattgaatcttataccacaggatacgcaaaaactctgcgcaggcatgctatctaactagaacctccatatcacgcacacacactcatgcaaacaacaaaaaaccccataaaaatggggcttttgtgagcacacgtaagtgtacgtgagcatagaaaacaagtgctttctatctctttgagaactgaggagcacgacgtgccgctttcagaccgtactaaacatctctatggtgcgtttttccttgatattacgggctttttcgcattttctgttgtcggttgtcctattccttaaccatggaaatcggtgatttttcatcgaaattctcctggttcaaagcatcattcactacctcgaaaagttcctctggtttattatacttgaccctcgcgtaaatgtccatagttgtcttactattctcatgccctgccaggtactgaactgtcttagggtcaacgcccgcatagagcagattcgtgatgtaggtatgccgcaacaagtgcggtgttacatcgaaattcagggtatagcgaatcttgggattgttcctctgcgttgttcctaatgtcggcttgacggtatatttgatgctctgtccattcacatatttatagtaagttctctctttcgcagagcgaacaactacatactgccaaactctcgtaaactgagaataggaaagcggctgtccctcactgtccgcaatcacatactccgatatggaattggcttttgcttcccgcaggcagtccaccaggcacttcggaatgggaatgtcccttttagctgcttttgtctttagaacggtagaaatcaccggcctgttatgctccgcgcgccatgcacgtctcacggaaatgtatggtgtggattcatccaggaatacacaatcccattgcaatgcaagaatttcttcccgacgcaagccggaatacaaaccaatcataataaaaagatatggcggaagctctttcaccgtatccaacagaaccgcaacctgttgatctgttaaggcatctttctttttcgatgcttttccgccctttgctgaaattcccacacatggattatcggttatcagctgactgcgctctgccgaataaaacacacacttaatcagcatatttaccgtatcatacagtcctttcgatttttgagacagcggaacaagcgccagacgaatatcatccgcagtcacttcctccatatacatatctcccagagagctaatgacataattcttcatattctgtctgtatccttttatagtagccgcagacacctttgctgattgcatcagcagccatttctcacaatactcggcaactgtcggatgctttcggtgaaagatgatctcatccacctgtctccgggcctccaactgcttttcatataattcttcacaggtggtcgcatataagctgacctgctttccatcggcatctgtaattctggttctgtaatacagtgttccttttcttgtaaccgttccgtactctggaacgctttgttttttcttagccatacaaatcttcctttcctgataatgagtgttcttaaattcacaccttctttttatcagaaagcacccacttaatcaaagatacggattatgtaaaacaaagagcgagacatccttgcctcgctccagctttgtttcctactctttataattgttatgcctgtgctgcatcccactgggcaaatgcaccacccattgttcttaccagctcatccggtctgttgtatttgacctttgcgtaaatatccatcgtaattttactactctcatgccccgccaggtattgaaccgttttcgggtccacggacgaatgaatcagattcgtaatgtatgtatgccgcagctgatgcggtgtcacttcaaaatccaaactgtaaatcactttgccgttatgtgctgccttttcaccgaggaccggcgtaaccgtgtgctttacacgctttccatcctcgtagcgataatagaaacgctccttgactgttcgggttacaatgtactgccaaagccgcttgaactgtgtgtaagacagcggatcgccctcccggttcggcaccacatattctgactgtgaattagcttttgtctctttcagacagtccgccaggcaaaccggcaacggaatatttcgatgcgcggctttcgttttcagctcatccagaatcaccggtctgttattttccgtgtgccatgccctgtgtaccgttaaataagggcaacccacatccagatatacagaatcccattttagggcaagaatttcttctcgccgcaatcctgcatacagccctaacatgacaaatacatacggcggaagtccctgaatggcatccagcagtctggtggcctgttcatccgtcaatgcagctttgtccttctgcggaacgcctccacctttggccgtaaggtaaatcgttgggttgttatcaataatcttactttcctttgctgcacggaaaatggatttatacaggataaccactgacttatataccgaagcggacttctcggaaacaggaacaagtgcaagctgaatgtcatccagtgtcacatctgccatccgcatctgtcccagttcttttataatgtgccgtctgacctttgatgtataatctatcagcgtggttgccctcacatgaaccgactgcatcaaaagccatttttcacagtagtctgcaaccgtcggggatttccgacagaatgtatcgttgtcgatctgctctaatgctcccaactctttatcatataattcttccggtgttctcgcataaagggccaccagttttccatctgcgttctgaacccgcgttctataataatctatgccgttaagcgtaactgtaccgtattgtggaattgctctttttctttttgccaattccgccacctcctaagaatatactccagcgctatatctatgttttatcagaccattccgtttccagcaaggatacggatcgactcacactccagctctgcgaggtctacgataagttgcgttcttttctgctggctttgctctgtgggtgcattttgcgatatactcctgaaggcccgctgaagtaaaatacacacagccattctgcacatattgcacataagaaataagaccgttgttacgggccgcgtccagggttgcaatgctgatacctaaaatttctgctgcttcttttcgtgtaataagtttttccataaagcatatttcctccaatctgtcaagtctgtcatcgtgtttgttcaaagccacatgaatacgctggcagccgaaactgccagcgcatggtatctgattttgaacaggaaactgcaaacgcttcctatttataaaactcagctttcgtcacatttgccacgccccctgacgatgggaacacaacaggtctccgctggcgcggctgtcataactccgcagcatcgttcgtatcgtgtgccgcagggttccccccaagtctttggcgggccgtgaggaagtatctttaagcccccatgcagtcatcgcgccgaatctgccacaatccgttttatgaaatcgtagatcgctccgaagcagttctttcatcacctccctgactgctccatcttcgcggcgtttcacattcgctcgtacatgagttatgtacctgttgtgctgtctattcgattgtcaatgtactgatgaaggaggaaaacctgtccttcttattaacactgacaaaaaaggcaaaaaacaggcgcatcaaacgaaactttatcaaaaatattttccgagctgctttaagccgcgccggatactgtctcggacacggcttgggtctacaccttctacttcggcaatttcatttaccgtcattcccagatagtatcgggcataaattcgctttgcctgtttctccggcagcttcatcacagtggcatagacctgctcctgaaactgtttttcctccagaactatctccggcgtttgcggcttcaacagcactgcattttcaatgccattctcgcaatccagagaatactgggccttgtagcgatacatctttcgctcatacgcagcctccgcacgttcagctgctcgaatagtctccattacttcctctgtcacatctataaaaaagtctgttgtataaacatcaggataaagttcccgaaggttaattttcttcattatgtacctccatttcgattcacgggtgattgacgggtgaatcgaatggaggcggggaccgacaccggcagacaatcggatcatctccgaaaaaaaggcaacaaaaaacgccagattcccgcaatgggaaactggcgcgccaagaacagtcattattatgctgaatcacatggaacgataatgccgatgcaatgctatacttgcccggaggaggggcaatgctttttttaattgatgtagatcatgggagctttgaaaaagcaaaagtgacacggcaaattaacctccaagcggctaccgtgtccctgcaagtcgtcattagtttgtgtaaacgcaaagaaacggcggctctgaaattgtccttcaaaaccgccgattgagttcaaaccttaaaatagcgcacgaaattatctgccccagtcaacggtttttttctttccccggacggggcagataacttattatgcagagcggagccgatgtgcgctaatcggttccttgtactttctccttcagctttcggaaagatgtatcactgatggcgtgttcaatccggcaggcgtcttgttccgctgtttcctgatcgacgccagcagcgataaactgctccataaaaaacaaatggcgttcatagattttctcggcaatctcccgacctatgacggtcagatgaaggaacccatcatcatccacggtcagaaaacctccatttttcaaaacgcctaccgcatggctgatactcggtttgctaaagcccatgtgccgggcaaggtcaatggagcggaccatgcccattttcttttgtagaacaaggatagcctccagataatcctccccagacgcatgaatcttcatcagttcctcctttatgcttattgttgaatcctccagccctcagcctgttcccgaatcttaataaattcctgataggttcccctttgagccagcaattccttatgggttcctttctgcacgacggttccaccatcaatgacaagaatttgatccgcattttcaatcgtcgccagtctatgggcaatcgttatgattgttttaccatgtgtcagtgcggaaatagcctcttgaatcaaatgctcattctctgggtcaatgctggccgtggcctcatccaaaataacaatcggcgcatctttcagcatggctctggcaatcgaaatccgctgcttttcaccgccggaaagagaagaaccgccctccccaatgacggtatcatatccatctggcaaggccataataaagtcatggcagcgcgcttcttttgcagcggcaatcatctgttcctccgaagcgtccgggctgccgaatttgatattgttacggattgtatcccggaacagatatacattctggaacaccatactgatattttttagtaagctgtcacaggtaaattctcgaatatctgtttctcctaaagtgatttttccggcgtcaacatcataaaagcgtgcaatcaggctgcacagggtagacttgccgctcccggagggacctacaatcgctgttgtggtattctgcggaatcgtgaaattcacatcatgcaatacagtccgtttatcgtaaccaaaggatacatcctgaaaagtaatgtcatacgaggtcggtgtaatatcttttccgtcttggtcgatatattctgcattttccagagcttccagcttattcatagcagaatctataagacccagcatgtgagccgcgtcgttaatgttttccacacttccaaagattacgaaagaaaacagaacaaacatcaggaaataagcaagactcatttgcccgttaagtgtctgccatgcacagataaacacaatccccatagatgccagttttaaggagaacagatgcaagcagttaaatggcgtatagcctttttctactttgatatgaatatttttcaaatccgtatttgccttgcggaaactttcgatagaagccccttcctgtccgaacgatttaacgatggacagcccgcggatatattcaatcgcagagccagacatatcctccatggcctggtgcgtgatagcagcggtcttttcactatgcctgctgataccatgtaaggccaatgaggaaaaggcaacgccgacaacagaaatcactgctgcggctggactcaggaaaaggaaacacagaagaattgcaataaactttgcatatccgttgatgatgatgtcaaccatcttcattccctgcaattcaagtgtggatagctccgtggtaacacctgtcagaatatcgcccacgctgtttttggaaaaatatcccataggaacccttttcagcacatcgcctaaatggattcgctgccctgcggccacttcataaccaatgctttcctgcaacaccgcccgcaaataagagagtagaaagttaagcgcaatcgagccaacaataatccaaagcgtctgccagatcagggaggattctattgtgttgcctgcccaataagctgcgattgctttatcaagggcataagcggcagccattgtagggatcgccgtagacaggctgctgaaaaaggaaaaaacagagccaagatagaggcgtcccttatatttccccgcccatttaatgatccgtttcatagacttaaacatgagcggccacctccttcttttcactcacagaccaattcttcgccccgatgtgggctttccacatatccgcataaagcggacaccgcttcaacaattcttcctgctttccgcaatccacaatccggccttttttcaacacgacaatctgatctgcgttctgaatggtggaaaggcggtgggcgatcacaagaagagttttaccctttgataacgccatgatagatttctgaattttatcttcgttctgcgggtcagtaaatgctgtcgcttcatccaaaataacaatcggggcattttttaggatcgccctcgcaatcgcaattcgctgtttttcgccgccggacagcctctttccggcatcaccggcaggggtatcatatcctttgtccaaacgcacaataaattcatcacagcaggccgctttcgccgccgcatatacttcttcatctgtggcgtttggatttccaagacggatgttttctttcagggagcaattaaacaggaagttatcctgcgtcacaaaactgaccagttcggaaagctggcgtatagacaactctttgatattcttccccccaatggtaatgttgccgcctgtcacgttccaaaaccttgcaatcagacgggcaatcgttgatttaccgccgccagacggtcctacaagtgccgtaaaacttccctctggcaattccaagttcacatcatgcagtacttcattttgctcggagccgtcataggaaaaggttacatgctccaatacaatatcattgcggggtatggatacgattttccctgaatccggcagcacaggcaggttcaaaagttcatttgccgcctctactgcatattccatagactttgcttcgttaatgaaagtggttgctttcatcaacggcccaacaatgctgagggaaagaataatccccattgcaagctctgcgggggaaatacttccattctgtaccagcagaaggccgacaggaagaacccccagtagcgttgtgggcataatcgccatcatcaggttcatcgttttccatgtgctcttaaaccatgccagggtaaactctttgaacgactggacagcattaacaaatttttcataggagcttgtgctttgattaaaagcctttacaacctcgatgccttccacatactcaataataatactgttgacatggttatttgcctccatataagcggcgtactgactgttataattcctcataaggaaaaacataggaatcatggccagcaccggagcaatcagaaccgccaatcccatgcgccagtcaatgaccatcatccaggtaaaaattgcaacagggagtaggaggttagaagtcaattccgggatcatgtgtgccaaaggcggctctaaatcctccaccttatccatgatgatatttttcagatagccgattcgccgccccatcacttcgccgagaggcgctttcatcagccggtccgcaattttaagccggattccttccaaaatggtataggctgaaatatgcgccaggatcgtagagattccatggcaggcaacccgcagcaggtagcccgctgctccaaccagacaccaaatcagaatgccattcagggtcacattctgattgataaatgccagcaggatttcatatacagcccaaaaaggaataaaccctcctgcaacgctcagaatggcgcagaataccgaaagagccattttccccttgcatggtgcggcgaaggaaaacagaattttcacccaattatctttttgctgcttcattacaatcaccttccttctttttagtcagcaaagaaaaaaggatgggtagtctttgctaaccatccttattgtagcagtattcaattcttctttcctctccaaaacggcatttatgcaccgtttagaaaaaagattttcgatattccatcggcgtctgccctatcacctgccggaaagctgttgcaaatttactggggctttcatatcccacagctccggcaatttccgcaatcccttttttggaatcctgccggagcattgtggcagcaacgttcatccgataacggcgaagataggaatacatggaatctccgtatatttccttaaagcaggttttcatccccgtcaacgaaatctggaatcgttcagctaattcatccatcgtgtaatgctcctgcaaatttgccgtaataagatcatggatcgctttgattttttctacctgacctttatagaaataagggcgatcttctttggaatcagaaaactgcaaagcgtccagatataaaagcagctccagggcttttactttatagtagtcacttttgatctgctgcgggacaaagtaaagctctgaaaaaatatgttcaattcctggctcattatgaatcacaaacggtttcttgtcattgcaatactttttttgaagctcgtacaaatcaacagaaaatccgccaaaaaagtctttcagcgccggcacagcaatgtccagatcaaatcccagagtcatcccatgatagtggcagagtggaaagcagaaccgtcccgaatgggaacgccggtcatccacacgcatctcattctcttgcaaatagctatacgcatgattgtcaatctcgctttcgatccgtccctccctgcaatggtctatatagagaagcgaactgtccgtactactctgaaagtaggaggtacattctttcaggtgcatatcgctatacatcacaaaagcgccatcaaaaattttgtgggctgtcatggttccctcgccgctctcgtcaaaaagctgcaggacaacgcaatcctcagtttcaatgacatttttaacatttgagccgcagtttattttaccatcaaacagtttgatttccgccgcctccttccatcataaagaaattaaataaccgttcccgtccttccgtatcctggaggaaatagctttcctccaatctgccgttttccagatggatcacataattgcagcacctgagtataaattcaggatcatgggtcacaatcacaatggtttttcctgaatcggcaagtcctttgaccgaatcggccacctgcctcatatgaaagagatcaaggccgctggtaggttcgtcaaatagtataaccggacgttcagaggcaatcgcagaagcaatcgccacacgttgtttttgccctcccgaaagccccatcggatggcaggctttgtacgggagcaaatccatttctgtcaagatagcctctgcctttgccacattttcaggcgattcatcggaatctttccccggcatacttaacaggacttcctctaaaacgctctccgtaaaaagctgatgatttacatcctgcatgaccatatagcatagcttcagccgctgtttgcttgaataggaagtaccatctttttcgaggatacctttacatcttttttccaatccgcataagcaacgagatagtgtcgtttttccggctccattgtgcccgatgaccgccgttacatttccggcaggaagctctatattttccagagaaagcgtttccggctgtttcttgtatgcgaaatggaagtggttcagtttccatatcccctgccctgaatgtagactggcaggctcaatatctgcaaactcacccaggccaagaggccgtaatcccattttagctttttccgccgccggaatcaactgaaattccggcaaagtataatccccttgtatttccccgtcgcttaaatatatgatcctgtctgccagatcataaagatagtagagccggtgctccgcaataataattgttttgccctgtgacttcaatatttttaacagtttccgaaaatcagcgatggaataggcgtcaaggttggaagatggctcgtccaaaacaaatacatccggttccacagcggcggcagatccacaggcgattttttgcttttccccaccggaaagggagaaaacacttctgtccagcagatttgtaaggttcaactgctctgagaccagctttacccgctttcggatttctgcttcttccaatccatggttttcacatccaaaggcaatttcgctggtcgtatccacattaaaaaattgagaacgtggattctgaaaaacagaacccactttttttgatatatcaaacagggaaagcccgctcatatcttctccatcaagcatgacagtgccttccagctttccatcgtaataatgaggaatcagtccgttaaacagccgtgtcagtgtggttttaccgcagcccgatgttccgcagagcagtacaaaatccccgtcgttaatagacaggtcaatatttcttaatgttccgtgtcctttcctgtccccaatgtcagtttcatttggagggtaggaaaaagaaacttttttacattcgatcataggcctacctccctgtaatcatcgtgacaataggaattgcaaaagccaccacacatagcagcaggaaaaaaacatcctgcacatgaaagccgatttcgcagatgtttgtcctcttgaccggaccgcccaatcctcttgtcagggctgccgcatttaattcttccccgatcttgacggaacacatgataacagggacaagcctgtattccagcattgcactggctttgcccccgccaaaacggattcctctcattttcatagcgtcccctatggcattatattcttctacaacagtagggaaaaatcggaatatcacggacataggaatgatgatctgctccggtaaatgcagcttcttcatggcggcaacaaactcgctgaccgtcgtcgtcctgaccgtgatgtatcccatcataatccccggcacaaaccgcataaagaaaccgcagattgcaacaacaagaaagttaggaaggccggacaggtgggggagcgcccatagttgcaatatatagctgccgccatataaaacaaaatagataaccgatccattccacgatttttccgtgagcagcaggatcaatggaacagctgccaaaataggagcaaactgtttagaagcagccccacctccgccgctcaagacaaagagggcaatcgtgataagcaatgccaactttgtccgagggtctaacgacaggccggtttccttttttttgcttgctaacaattcacggcgcattatgcaatacccgcacgcttaaagtgctttttgaaaattttctggccgatcacaccgccgatcacgccgcaaacgaatccggcaatcaaaagaagggggagcgtatatgccgagatatagctcataatggaatctgcatactcttgtccataaccgctgattagctgctgatagtagctgtcccgtgttgcaacaatgggaatgtagtttccgatgatccacatggaaaaaacaccatgcgatatgattcctttttttgcactcttataatcgccggatttcaaaacaagatcagccaggacaccgaacacggcaccggtaataatgctccaataccccatgccggtcagcaacattaaaataccgcagatcagtcctgtcagcgataccattccaaacttctggactttagaataatacagcatcattacgattccgccaatcagcggaaccagcacgatcagaagcggaagaaaaatagggataaatcccagcatggcaatcgccatcatcaccacaaaatagatcgcagtgaagattccaacattgataaggtcttttccttgtagtttattcattatttggtcctcctgtttgcttttgtgttagcacgaactaaccgcatctcagtatagcagatatgtctgtatgtttcttctccaaaaaggcattttcgctccaaatagacaattactttgcttttgttatctttacggggagtgattgcctgcgtgtgtgcgtgaacatagaactattcaacattgaacagaggcggttcttgcataatttgaaatggaaacagccaaaatcaccgcttcaaattgtagtattagtagagggagaaatagaaggtagggtttcgatagcaagcacagcaagcgagtacccgcttgcgatttttcggattttcaggtcccttgcccgaaaatgaaaaatgtttgttgggataatctcaaactcttatgaagaatggaggcagcgcatggcgaaccgaaaacggaatatccagatgaattttatgtcacagagaataaaaaacggctcatagatgagcggataaaactgatagcctccctaccgcattctatatcattctcgtttggcaacgaactaaaagctgaaatctgcaattcatcctcatagttcaattagcagccggaaacgccataatcatggagcaaccatgttatcaaaaaggaatcagcataatcagtcctgttctcaagcacaataaggttattcctttgtgcaaatcggaacgataaaatatatttgaggtgaacgattatgccgattgatgatttaactgctttagggcagaaaatgagagaggccagaaagaataaagaactgacacaacaggaactttccgatctaagccatgtttctgtaaagcaaattgccaatatcgaaaaagggaaaatgaacccgtcctatttgattttgagagcattggcaaaggtcctgcacatctctttagatacgcttataaatccagatatttctctggaggatgagggtgtcaatcagatgaaaatgctttattccagctgtccgccagaaatgcgcgacaccctgttgcatcacacacaggaaacggtgaaagagctaacagaattgtccgagaaatttgaaatgaattgagccagtgagtgaaatttaacgattctctcactggttcttttcattttcggagaaaagaggcaagcaatgccggtgttaatacacaccgacccgcagagaagaaaatccctttgtgattttcctctccgcttgcttgttgagggcagcgcccccaagcccctttgaacacagaatttcattctgtggctgcgcgttctgcgaacgcttttgaccaggaccagcttaccgctggccgtggtctttttctttttcaacatcctgttctacctccattttcaggacccgatccacattggcctttgccgttaaaagctcccgcatttcttcacgggaacgccggtactcggcataggtctttttcttttcttccagcaatttcgcatactctgtctgcaactctttgacctttggcagcttcttgacgcccatctcatcaaaggcattcttagcagcttggtggagcagaatttcttcctcatgttcttccctgaatttcttagagtaacccgccttgcggtatgccacatagacctcacgggtcttggcataatttacgatgtgagtacgcagaacagcgatctctgccatgcgcttttcagccgctttgatctgcgccgaaagctcattgtgatgtgccgtggcaaccgcagccttttcttccaaaaccgcatactccagcaggttgtgctctgacaggtaattcatggtctgcgccatctgcttgagattgaacaccttagcccatcgagcatagccagcgccttttccagcctgcaattttgactgaatgtccaccagcagattgaccttcggcagcactgcctgtgtgaccgttttctttcgtggggtatgcgttttcttcccagaaataactgcctgtaaatcttccaatccatatccttcgcccaggctgtccatacgggctgctttctcccaaccggggagcttcagacgatacgattttccacgctttgatacctcacagccggactcttgcagcagcttcagcagctcctcaaaattagcaggactttgtgataatgcgttgtcaatcgccacacgaagcagctctcggtgagagggttttgcctgatctcccagccatttgttatagctctttccgtgagggttcggattctctacaatggacagtccgttttcaatgcagatggtatcacttaacctgcgaaccgccttggtactgccccaaaagtttcggaattttcggtcatattctaagctgaccgatgaccagataatgtgattatgaatgtgcgacttgtctatgtgagtgcagaccacaaaggcatggttgcctttagtaaatcgcttggcaaattccacacccagccggttagcttcttccggagtaatctcgccggggcggaaggactggcgcacatgataggcaatcacatcatccgcaccgcgcactcgtccggtagcaacgatatactgcctttttgctaaaagaaactccgcatcaaccgttctgctgtcacacgcaaatcctgcgatgagcctgccattatctgttttctgtggatttgctacatagtcgatgatgtcactgatcgcccgactctctgtgcggcctttgccgacatgaagtggcatgattcttgtagttgccataaaaagccctcctctcaaaatattttctctgaactctttgtgcctatcgttgaaataaactctccttatgggtataatataaagaaactaccaatacctcaaaggagggattttatgatagaacagctcattgctgaagcaaccgaatgtgatttcaaagttgctctcgaaataaaaaagccaaaaagctggttaaaaagtgtcagtgccttttccaatggaattggcggcactctgtttttcggagtctccgatgaccgggagcctatcggcttgtccgatgttcaaaaggatgctgaagcgatcagccgcttaatcaaagaacgtatcacaccattaccgcagtttatcttaaagccattgcaggaagatggtaaaaacctgttggctctggaggtttctcctggccgcagcaccccatactattacaaggcagacggagtgatggaagcatatatccgtgttggaaatgaaagcgtaattgcccctgattacattgtgaatgaactgatcttaaagggaaccaatcagtcctttgataccctaacaacagacgcggtaaaaaaggattacagctttacacttctggaagcaacctatctggaacggactggtctccgctttgagccatccgattatgtctccttcggtttggctgacaaaaatgggtttttgaccaatgccggaaagctcatgaccgatcagcacacagtttataactcccgtatgttctgtacccggtggaatggcttggaaaaaggctctatctttgatgatgcgctggacgataaggaatacgaggggaatttgatttatttactgaaaagcggcagtgaatttattcgcaataattccaaagtccgttttgtcaaagaagctcagtatcgggtagacaagccggattatgctgaacgagctgtaacagaggctcttgtcaacgctctcatccatcgtgattatattgtgcttggcagcgaagtccacattgatatgtttgatgatcgggtggaaatcacatctccgggcggtatgtttggcggcggctcaattcaagaatacgatatttacagtattcgttcgatgcggcgaaaccctgtgattgctgacctgttccaccgcatgaagtacatggaacgccgtggaagtggtctgcgcaaaatcgtcagtgaaaccgaaaagctacctggatatacagcggcatataagcctgaattttcctcaacagcaacagatttcagggtcgtcttgaaaaatgtaaactacaacttagaggatgacacccaccaagttatccaccaagttacccaccaagttattgaactatcaacggtatccaaacagattttggctttttgcacaacaccaaaatccaagaaagagcttgcagtattttgcggcttcaaagatttaagaaacttcactttgaaacatatcaatccgcttttagaatccgggcaattagaaatgactattcccgataaacctaaaagtcgcaatcaaaaatatattacagttcgttccgaataaacagagaagcagggcattgggtctcatctcccattgtcctgcttctttttcattccaaattatattcacatcatttacccatacacccaatcctgtatcgcaaatttcaaactctgcacctttcccagcagccagatcgcagccagcggcagccccatcgggctaatcaaaaatgccataaccagcaaaatcacaccattctgcggggaataggtaatcagcacagccacgccaagcagagcaattaccgtgctgagcagaccaagcaccagaccggatatgtagatcagccccgtgcagagccagacaaaaagcgtcaacaccaaaatgaccggtgcagttacaatcatcagcaagcatttcaaaatcttcattccagttcctccctccaacgctccaaataccgtttgcacagggcatccgcttctctcacatcatcttccgtcaactcccgtctgcctttggtcagttcaatctccacataagtccggtaatcatcggctaagagatcgaacagttccttgggagtatggcacatctcgccggtgcaatagtgaaaattctggtcaaattcaacccttacacatccgtgacggctgatatacacttcgatggtctcgtctgcggccaggtagtccgcaaaaatctccaacaccttttcaaaggtcagcatctgttttcgctcctttgcttcactttttattctactcatattatccggtacggacaggcaaaaaacaaggataccgccaaaaagaaaaagcggaggaaggtgcggcgaagaaacgccgttcctccctccgcaaatggagtatctatccttgttatgaaagtttggagagttgggtaaggatttccttcaccccttcccacagttgttcctgccgctgggatatatcctccaaatcggcatcataaatccgcccggtctcatgcaccttgcgggtcagctggtttaagttgttgctgctccggcgcagcagggataccagttctttcagttccggcaagtccagctgcaccacatagccgtccacagccattttccgcagataggcgctcaggttttttgtcccaaactgtgccattttctgctgaatcaactccatttcatcagcggatacccaaaacagaaccggcacatcccgcttgcgcttggggctgctcatcgctccggctcctgtttcttcggggcggcaggcttatgggcaggcggttcctgtttgagcttttgcaggacagaacttttctgctgttcctgcatggtttttctggcctgcctggtaaacagatcggtcagaccggggttgaccccatccacaaccagataggcacagtggcgggaagcgccgctgtcctccggcatgggaatggtttttgcccaggctttattgtcctgagagatacgcccgtcatggttcttgcgctggatggtgtttgcaagaatgaactgtacccgttccgtcccgaacttttccagcacatctttgaccgccgcctccgtatccagccggttctctgcatagtgggcgctgatggtctgctcaatggcttctttgcaggcgctgttcgcctgatacgaacggttatattgtgccatctctccatgctcggacgcataggcggcagaatgggggtagagaggggcagttcgtaattcttcctgcgccttgcacacatcatcggcacggttttcaatgctgtcccggatcatatccatatagccggtctccagcttttcaaaataacggtacacatccgccagcggcgagggagattccaaaagcgcctgggcctgtgcgtcggtcagctccagctcctccatcgccatcacaatatcctcacggacagtatattcataggtgtggtgcaggatttcttccgggggctggcttttcaaccagtccctatatttttcctgctcagtggccatcttttcataaagggccgtattcagattattggtattcatgttatcgcacctcctcatgctgttttggtttcttttctgtactgcggggcgtcgccggacgcttcaggctgtccagcaccgaagtccgtgtgcttttggcaacaacagcctcggtgtgcgcctgtccctttccgtcgatgttgagcaaagtatccagctccaccagacgggcatttttgcttcgcagttcttcttcataaaggaatggctttccgacttcctcctttgcggcagcctgttgctgatagaggttatccagctgggcctttgccgcctccagacgctggggcatctgggcgagggcattgtcgatacgagtaagatttccgcgagggtctgtaccaagggttgcccggtgggtcatctgtcctttcagcaggagcgtatactcctgtttccaagcggaaaattccacggatatggcatatccccggtagctgccaatctgcaccggatcggaggttttgacctccttgcaggcatccaaaagggctgcgccggcgttctccttatcggtcagcagatcgccacggatttccataccagcaaaaccgtcctccgggtgcgggtgcgctgccaaaacctccagatcggattcaaagcccttgataaagcctttgtgcttttcaatttcctccgggaagtatttgagcagctggtcctccagacggtactgcttgctctggtggtcggctttcatcagcttcagcttggcaacctccacatccaaatccatacgctccttgatgcggggatctccggcgcacagggctttgatctcggcaaaggaaagcgccgtttcgtccacatcatcgcaggaacgcaccggcgatttagaagtcatgatctgactgatgaatttttgcttattctccaccgtctgccagaggtatgcgtcaaaggttccttcggtcacatagcggtacacatggacaagaggattctggttgccctggcgctcgatacggcccttgcgctgggcaaggtctcccggtctccacggacagtccaggtcatgaagtgccaccagacggtcctgcacattggtgcctgcgcccatcttggcggtgctgcccaaaaggacacgaacctgaccggtacggaccttagagaacagctcctttttccgcacttcggtattggcttcatggataaaagcgatctggtcggcaggcattccctgagcaatgagtttctgacgaatatcgtcatataccgtaaagaccggttcctgctccggcagaggcacagagccttccaatgcgtgaagcagtggattatccagcgttttcgccgccttgcttgcaggagcttttgcctgcggtgtagaaatgtcgcagaacaccagttgggtcagcttgtcagctttgccatcccgccagatctgcatgatgttgtccacgcactgattgacctttgtgccaggttcatccggcagcatctggttgacgattctctggtccaggcccagcttacggccatccgaggtaatcttgagcatattgtcctgggacgggtcaacggttccgctgtgtaccagcgatgcgcgctccgaaagggtcttgaccatttcctgctgatgttcggtaggctgcgccacgatgttgtggtattccacctccggggtgggcaggttcagttggtcggcggtcttgatgtccgccacttctttgaacaggttcatcagctccggcaggttgaaaaacttggagaatcgagtgcgcgcccgatagccggtcccttccggggcaagctccaatgctgtgacggtctctccaaatcgggaagcccagcagtcgaagtgggtcatgttcagctcttgcaggcgttcatactgaaggtaacgctgcatggtgtaaagctcggtcatggagttgctgaccggtgtgccggtggcaaaaatcacgccacggtttccggtgatctcatccatatagcggcatttggcaaacatatcggaggatttctgtgcgtccgatgtggaaaggccagccacattccgcatttttgtatataaaaacaggttcttatagttgtgagcctcgtctacgaacaatcggtctacacccagctgctcaaaggttaccacatcgtcttttcgcccctcggcttgcagcttttccagtctggcttccagagattttcgggtacgctccagctgcttgacggtaaaacgctcgccgccgctggcctgcacctctgcgatgccctcagtgatctcgtcgatctgctcatagagaagcctttcctggcgctcccggctgatggggatacgctcaaactgactgtgccccatgataatggcatcataatcacccgtcgcaatacgagcgcagaacttctttcggttatgggtctcaaagtccttttttgtggtaactaagatattggcggaaggatagagacgcagaaactccgacgcccactgctcggtcagatggtttggaaccacaaagagagatttctggcacagtcccaggcgtttggcttccatcgcagcggccaccatctcaaaggttttacctgcgcctacttcgtgtgccaacagggtatttcctccatacagcacatgggcgatagcgcttttctggtgttcccgaagggtaatggctggattcatgccgccaaaagtgatatggctgccatcatattcacggggacgggtagagttcatttcctcgttgtactggcacaccaaagtctggcgacgctccgggtctctccagatccagtccctaaaggcttcccggatcgcctgctgtttttgggcagccagggtggtctccttggcgttcagcacgcggcgctcttttccgtctgcgtcctctatggtgtcatagatacggacatcccgcaggtttaaggaatcctccagaatcttgtaggcgttggcgcggctggtcccataggtggtataagctgccacatcgttgtaggatacagaagatttccccttgatctgccattcagcggtaaaggacgaatagttgacctcgatactacgctggagataaaacggggtattaaaggtctcatacataaattgctggatatattccttgtcaatccaggtagcgcccagacgcacctcaatctccgacgcatccaggtctttgggctgggcggcggtaagagcttccacattgactgcataaatcgggtcctgctgtgcggcccgttgcgcctgacgcagtttgcggcgtacattgccggagaggtattcatcagcagtcacataatggggtgtgccgtctttctccagctgtcccggtacacggaagattacgccttgcagctctccggccagttcttcttttgtttttccggtaagctggctcatatagtccatatccacgcaggctttttccgagatggacaccgccagtgcttcacttgccgtatccaccacagccaccgcttgatggggcttgatggtccgcttggtgaacatatctgccttgcgttccagctttccgtcctcgtcgatgacttccagcgcacagagcaggtaataggaagaatcgtctgcataggccagacggtttgcacggtcattgatgagaccgtatttggaagaaaagctgtcatagagactgttcagttccgcctgcttctcccgaatggtgctgtccggaaccgctgcatccatctgaaggtcgatcagttcctgcacacaatcacgcagtcccacaagaccttttacacgggcttcggcggtggcgttgaggtcagggcgcaccatacggctgttttcccggtagtacacctgcccgtctacaatggcataggaatagttcttcacattggggtcggcaggaatggaggtgtcaatagcttcgccttcgcccagctccggcagctctgcctcctgataagtgccatgaatgtacttcacagcatcatgcagctggtcggaaagctccagtccctcgatagggttcacggtgtagtccataccatgagcagtgcttaccggctcctgtctgcccagcaccatttctgggtggtcgataaaataccggttgatggcaaacccgtcctccgtctgtccggtctgggtccattccggcacaatgtccaacgggcggtcccgcttttggaggaagatgatgtccgataccacctcggcaccggcattctttttgaacgcgtcattaggcagacggatagctcccagcagctcggcacgctgggcaagatagcggcgcacggtggaatccttggcgtccatggtatatcgagaggtcacaaaagctaccacaccgccgagacgcacctgatccagtgctttggcaaaaaaatagttatgaatactgaaattcagcttgttgtaggctttgtcgttgacctgatactgaccgaaaggtacattgccgatggcaaggtcaaagaagtcacgcctatcggtggtctcaaagccgcctactgtgatgtccgccttgggatagagctgctttgcgatgcgcccggaaacagggtccagctccacgccgtacagacggctgtttcgcattttctccggcaacataccaaagaaattgcccacacccatagatggctccagaatatttccggtctcaaatcccatacagtccaccgcttcatagatggcctgaatgaccgtagggctggtgtaatgggcgttgagggtagagcttctggcggcggcatattcctccggggtcagcagttcttttagctgggcatactctaaagcccatgccggtttctccgggtcaaacgcatcagagagaccgccccagcccacatatcgagaaagaacctcctgctgttcggggcttgcctgctgtccggcagcttccagctctttcagcaaacgaatcgcattgacatttgcctggaacttggctttcggaccgccctcacccaaatgctcatctgtaatgcggaagttttttgcattgcggcgcaggttagccttgtattcctcataagatgcttcctcggcagctttggcattgggaaaggtctgccactggccattgacctgaatggaaaccgggtgttcgtccagcacttcctcaaaggttttctccggctcagtcacaggggctggcggctccggctcctcgatatgcagtcgttccaccaccacatcataaggcagattgttcttatcgcccgaatagacggccatggtctcggaatggaaggtcggggattcggtagccggttggggctgttcctgtccaaaaccgtcctgctgacgggcatacatcccgcgcagcaaaggcgcaacctcatcccagcggaaatacagcatagccagacgcttttcctctgcatccatgacttccagctctatgccctgtgccgtggtacggtaatcggcaatatcgccagtctccagattcagtgtctcgatctcaccggaataggctctgctcagccagtaggcgatctcgctgttgctcctgccggattgcagcagcgtggaaatctgctttttatccgcttcatccatcaatccatgagccaatacatcccgcaagtcctgatctgccttgtccgggtcagtaggaagaaactcggtatagtaagcattgcggcggtctgcccgaagcagctgctcgaactgttctttgcgctctgcccggtagatgggatataccatcccggtgggcagaagctgtacggtgtcctcctgcagctctgtgatctgataggcgtcatcctcgatatacacggtatcgcccacggcatagaccagggcggctgggtcataggaggttctttgcggaattgggcggcgaactgcgtcatattcctcatcggaaatggaaactttggaagtctgctcggcatctgacatcacctgttggataaacggatcattgtccagtttttccgggtctgccacctggccgttgacgatccctctttcctccagagcttcccggatggcgattgggtcgatgtcgtcaaaacggtcctgttcttcttcggtatagaaccggtcctcctgaatgagctgggcaagcctacgctgtaccttcggccagggcagctgcgtttcctccgggctgccggcacggacaacgaacaggctgttgctgttactgccgccgtattcctgagccagccatgcggcggtatctttttctcttgcatggtctttcatatagcggacaacagcgtgtttactctcgatattgccgttccatgcacaaagggcagtatcaatatcttcctgagaaagagggcgcagaagctcatggagctttggataggtctcgtcgatcacttcccggtgtaaacgctgacggaactccggcacatccgaatagagtcggatcagctccatatccttagaaccaagaaccgcacggcgcacagcagcattgccctcgatgacagcattttcacggtcagaatgaccgcaggcattgcgatatgcggtatcctcggaaatggcggcagtcaccacaggcttatactgctcaaactgctccccaagggtaggctttggtgtttcttcatccacctccggctgctgtgtttgaatggcatcttcttctgccagttccttttcagcctggattttgtcatactgcgcctgttcctgttcggtaagatagcggtctttctggacaagtgaggtaatgcgcttggcaaccttttcccagttcaagtgaacatccgggcagtcctgctttttatagtgcagtcctttcccatcgtgatcttcgccgctgtgtgttgcaccggacaaggcatgagagcgtccgccaatgccatactcgtctttgaggaatcttactttctccttatccgtatggttttccatgaagaacgcatagatacggccttttcctccggcgaaactgcttccgccggtcatggcggcgtcgatctcatcctcggtaataaagtgctggacggttggcactttggaaagctctgaagaaaaggtcctgcggggcaggtcaaggtccttcaggttctcccagatctccctcggtctatgatagtgaaaacgcaacaggtcacggtcctgctgataggcagtccagaaggcagcgtattcttccttgagggtctggcggaaagccgggtcactcagctgctccgtcaggcggcgggtctcctctgggaaaccattgcctttgatctctgacaggcaggacaaatatccggcttctctggcgtcctcactgagatcgtgatacagatgccagagctttttcgagaggagggagcgttcatagcctgccgcttctgcaagctccacattggaggcaaactggccgctttccaaaagctccccgatacgctctgcggcgctctcccaggaaatgacctgagcagacctgtcataacggacagacttcccatgggaaagatggataccatcctcggcataccatgcgctcacactgccaaggccattgccgccgtggtacagcgttttcagtatctcggcaatctcagcggtggttttctgcttttcaaaggctgcaaccacacgctccctttgacggtctgtattgccgcccaaacgcagcacatggtcaatatcattttgggcaaaagaaaaagcagaggatgtatgcgctacattctctgcttcatctatggattggatctgttccgcttcggagaggaacaggtttagagtcagctgttgataagctccgccatcaggatttcctcggcctgagctttgcaggtgttcatcagccccacccacttcatgggatcgctggctttcagttcctcggtggctcccgcttccttcgccagctggggcatcatctgctccagtctgctctgggcggtctcgtcgatctccagaaggtgctggtacagcttctcgctcagcaacatctggttgtagaggatgggacgatgttccttcaggtaggttttcctcatcctgccgtacttgcccaggggtttctccggctgctggctcagcttcaggtcgggaatcagatagtctccgttctggatataggtcatgggattgttcatcttgtttgctcctttcttggttggcttcgcgctctgcatttcggacggtaacgccgatctgccgcagcacctgctggttgatctggctgaccgctgttcccagcgccccgatggtggacggggtgttgaaatcaaagatcgccatgaaatcttcgtggtcgaagtagcgttccggctccagtccgcagcgggacatcagagcgtaagtgatgctgacggtggcggctgccttgaactgcactccgatgttatactcatcatattcctccaaaaaggaaccgtcaacgatatagaagaagtcctgctgatgctccgtccagtattcctcagccagttttccggctacctcagtgagctgtccggcaaggtcatcaccggaaacatcgtaggtgcgctccagcatagcctgcacggaatccagatggcgctcctccagctgccacatccagggggtgcgggaatgttcacgggttccggtgtcggaaatgtcaaagacatagcgcaggcggggcctgtccccggaatcgtccaccagcgcgatccccttggaaccgcgccttacataccggcccatcttttcattccacaaatcgtactctgcacaggcggtggcgtccggtcgctgggcgtagatcatcagctgttcatggaacgggtatttgtaaagtcgggaagcagtggtgagaaaccctgcccattcctgccagctccccgtgagctgcgttgccaccttgtccgccatctgtgcatatagttcagctttggttggcatggtgttctgtcctcctttcggttttggggtaaagaggtggggtggcaaattgccaccccatccctgcggttatggtgtttactggtcaaaatccgggtacagctccagctgggcaaagtcctcattggtcatcgcacagagcttcgtaagggcgctgtcggtcagctccctcagttccgtttcctccggtgatagctcgccgcgcatctcacgcaggctgttgatcaatccggtgcggctgccggtattgtaaatgcacatcaggttcatttcctcaaaagtaaagtttcccataatcaaatctccctttccgcactcttttttggcgctgtctttttgtgttctgctttgggctggtttttcagctgatccacaacggatttcttcttttcccgttcctcccgatgggtggcggctgccagatccatcagggaaatgggctgaccgcttcgggcctgctgttccagctctgccaccgtaggctcttttgcgccattgttgatgataccgtcgatcatgccgtaatcgtcctccacggccatctccgcatttttcagaggattttgcggcaagaatccaggaatctgggtaaaaccaacgctgtcacagtaatgacaggataccttaccgtcctgcctgatcgcaacgatgtcgctgacgctcatggaggggctgtgaaagtccatgggtttttccagattgaattgctgatagagtttttccagctgctccagcacagtgccagactcactcagaggagctgtgtagattaggtcataattgctgcggtctatggaaatatcatgggactttagccagtccagattcataaagcgcacattctgcggatcgtcacggctcacctgatagatggcaaagcaatctctgttctgggatagaaatgcctgttcgcgttcctgctgatgttcctgacgctccatgaccttttcgtggaactgagggcttttctcccattcctcacggtccacgccaaaaagaccgccatgatccatgatttcctgcgggtcaaacaccatgctctccgtattgtcctcatgcagcacatagacggtcaaaccggcggcatccagttccagcgcccgttctctggtaacagggaacatcccatcataggagtagccgtattcctgcatatctgatgtggagatctgctcatccggcatggggtattcatccagtgcctgctcctgtgcttccggcagctgggaagaagcagccatctgactgacctctgcctgcatctgctggtaggcagcttcctgcaaggtctcaatcatggacaacggtgcgtattttaccgagtctctgcccaaatcgttgtcatcacaaatctggagaactgccttcatgcgggaaatctccggcatatccagctgaccaccatccagctctttcatggacgcggcatcgtaaagggtatagtcccagccgctgtcacaggactggatatgaagataggtggcatcgtcaatcagaaacaaagcctcctgctggttggcatccgcccccagcacttccatttccggcattgccgcagccagttcctttaccgctttttgcaccagaggattatcacggtaatagtcgattgcctggatggtgtccaggtcaatggtctggccggtcaaaatcggaaaaggtccttcatagtcgcttccgtctttcagctcaaaaccaatgcccttgatcccgttcattcgttctgccggaatctcctgataaatgcggattgcttcctccaaagacagattatcgtggtattctccgaggtttggaaattccatgcactctgctacatagtaggtcagatcgccggtcggcagcctatcagataccttaatggcatctgctggctgctctatcggggcggtttccggctctacctttgcatgagggtcgattccgcgctctttgcagatttccttatagtggcgctcaatgtcggagatcaaagtgccggaggttttgttgatggtctccaaactgactctcagctctttcagctctttgccctggctccagcttgcaatatagccgaagctgttttctccggtctcgatgccaaaatacttgcagaccgcataggagatgctttcagcctccacttcctccgtgtggcggtttttgattgcctgtttttctgcggttgcatcttcctcaactgcaagacgccattcaaactgattttcgtccacataacgccaatccatatcagaagcaaactgttcggcttctttttctgtggcaaaatccaacttgaaatcatgcttggttccaccttcactctcctgcacaaccttccatgacggtagcatttcatattttttagggtcatggagcttgctgtgggcaatctcatgaaccgtggccgaaaccgtctgcacctcgctcatgccttggcgaatggcaattttctgatgatcagcagaaaaatagccgtccgtatcagcggccattgcttcaaaagtaatcggcaccggtgcgctgcggcgcagggcctccatgaatgcctcataatttggcacattgccggaaagggaggaagcaagctccggcaaaggtttcccgtcggtctgactcacatcaaagaccttgaccgggcgaaacatggggatctcgatttctttttcctctgtaacaatctttccgtctttatccagaatcggagctttggtatccgggtccagtttctgctcctcgattttcttcttgtacggtgtaggggcgatgatggtaatgccatgctcgcccttttttacatgacgctcaaactggtctttccacttattgtatccggctaccaatgtggcgtccggcttctgcatatagatgagcatggtgttgtttaccgaatagcggtggaagcgggacatgacggacagatagcgcatatacttttcactctcaaacagttctttgatgccctgctcgataccatctgtgatttcccttagccgttctcggttggtgggtttgttctcagccatgattttcaatctcctttccaagtgtgtgatttctgctgtgtgttctgcaatccatgccttttgttcttcttcactttcataaagaaaaaggtccagcaggtactctacataggctttcttctggattgcttccacaaaacgggggtgcggttcttcctccggtgtcctgggagaacggtcggcttcccattttttcagcagatagtagtaatcggacagtacacggtaacagctctgtcgatcctcccgaaacttctgtgcctcggttttttgccggacatatctcctgcggggcggggcctgactgtcatagatcaggccaaagtcctgtgccagtttctccgccgcttcttttggggagcggttaaagagctttgcggtaaagtcgatcacatccccatctgcaccgcagccaaagcagtggaaccgctggtctaccttcatgctggggttcttatcatcgtgaaaaggacagcaggccataccagttcgactgacttttatcccgtaaaactctgccgcttctctggtgctgaccgactgcttgaccgcttcaaatacattctctgccatgtgcctttaactgccggactttttcacagggggctggtatccggcggctttcgcacgctcactggcagctttgcgacgctcggcgctgtatggctcccggactgatacacaccgcttggggacggtaaagttatgggcgtcctttcgggtgatctggtcggggtgcttttttgccagcagttccagcttctccatcagacggggatcgtgggtatagacctcagccattggttctgcctggttatagaggagaatggtttcccgttccactaaagagagcttcatcggctgcctcctttccgctggtcaaattccagcttgaaattggcatactgtccatcgtcctccaaaaccacagtggcatcgtaggtcttgccggttttctccgaatataaccccgtcacacggacacggccatcgttcagcagcgcagacaccacagccttggtcggctgttttttcttggcagcccaccatttgttgtttttccagattgcaaatttgcaagaatcattctgacagaagaagcctttttgcagttctgcaacttcaccgccacagcgagggcatttgcccaccacctcacggggcggagtgaacaggtactcagttcccttgatgacctgataagtccccaccagatctttcagcatggtgctgatcccatccagaaactcctctggggcaagctgcccgcgctcgatctcgcccaggcgatactcccactcggcagtcagaagcggcgattgcagttgttccggcagcaccgtgataagggatactgcatcgtgggaaggaagaagctgcaccgtttttctgttcttttttcgctccagaaaaccggcagataccagcttttccaaaataccggcacgggtggccggtgtccccagaccttttcgctcggcgtcctccggcatattctcttttccggcagtctccattgcggacaacaaggtatcctccgtaaagtgctgaggtggactgcttttaccttctttgacgattgccgcagcaaccgaaagggtctgtccttcggtcagctccggcagagctttctctgcgccctcttttttcggctctgcatccttcattttggcacggtaagcgtcctccagtgctttccatccggggtgcttcaccgtttttcctttggcggtaaactctccaccggcacacgctgcaatcacaacagtttccgaatagatatggggctgggctacggcgcacagcagacgcagggccaccagctccagcaccgctttttctcccgcaggaagggcagaaaggtctgcatccttgagatttctggtagggattactgcgtggtggtcagttactttcttatcgttgatgaccgtctgcggatcacaggtaatggcgatccctttgcgaaacggcatagcgttggcaaccagattgaccagcaccggcaggctgtctgccatatcaccagtcagatagcggctgtcagtacggggataggtgcagagcttcttttcatacagactttgcagatagtccagggtctgctgggctgtaaatccaagcaggcggttggcatctctttgcagagtagtcaggtcatagagggcaggcagcttttcagacttttccttgcactccacctttttgattgtgacatttgcaccccgacaggtttctttcatctgcttagcagcggccttatccgccatgcgctccccggatacggtaagaccgggcagctccagcgccacggtataaaagggaatcggctgaaaggtgtcgatctcagcttctcgctgaacaataagcgccagcgtcggggacatcacgcgcccgatgttgagggttcggtgatacagcacggaaaaaagccttgtcgcattgatccccaccagccagtcggccttggcacggcagagggcagcatcccgaagtccgtcataatccgcaccggggcgcaggtttgcaaagccttcccttatggcagagtcctccatcgaagaaatccagagccttttcatcggcttcttgcaacctgccagcttatagacgctgcggaagatcaactcgccctcgcgtccggcatcgcaggcatttaccacctccgaaacatccggggcattcatcagctttttcagaatatcaaactgctttttcttatcctttcccactaccatctgccaatgttccggcaggataggcaggtcatcatatcgccacttggcatactttgggtcatagctgtctgcatctgcaagaccggccaggtggcccacgcaccagctgacacgccagccgttaccctccagatacccgtccttacggatggttgcgccgatcaccgccgccaaattctgggcaactgatggtttttcggcaattaccaatttatgttgagccatgatggttcctcctctctttgagccatcgggacatttcccggtgacagatacctacgcagggccttccataattcccgcaaccatagcaggggtggctgtgaggtaaagaaggaggacgggaagtttccttcccgccctccggcctgcgtgtcatcatgcgttcatagggactgtctgtgaatcgggtcatttcacgctgtcctcgtcatcttcttctgtgctgcccccgtcagcatccggctcgtccgactcctcatcctcggtttcccattcctcggaatcttcctcgccataatcataatcgtccagactgtcattgcccttggtcttaggcttgttcttaacgagcttcaagtaggcaaatacgccaccgcctcccagcagagccagcaaaaggactatcgcagccgggttcaatccggcaggcttctccttttccggctccgatgtttctgccggaggttccggtgctttgcccgtacatttactcttatcagttgcgcagaccgggcaggccgtattgactgcccctgcttcacattttgttgaacagctgcataccgcaggcatctcctctttgggttttccatcttccatcagcgccacaaggtctgcatcgtccacctgattcagaaagtgaacagcagtctccttgtcctcattcgccctatcaatcaagatgtaaaagtaatttccagctttggtcgtaacagtaataagctgcttattgcctccaaaatcatccaccaatgccgcattcccctccggtgtaagtgccggtgccggttctgtttcttccacaatcacattgctgtcattggtagaatcctctgccggtgctgccggagcctgttctgacccctgtgcgaaagcagggatcgtaaagccaaatgccacaaccattgtcaggcaaagggcggaaagtgttttgcaaattcttttattcttcataagcggtagcctcctgattatttgattccgacagtgctgtatctctgccgtggttcattccaccggaaagcatagcgttcagctgtgctggagtcatgcgtagcgcacgaaccatctgaacgatttccagattctctgcctccgttttctgtgcttccaaggtcttgagcttttcctgatattccacaatcttctcacgggttttctcaatttcctggtcgatacgttcaattttgttttttgccataaccgttcactcctttccacaaagtctgttaccagttcatcaggccgtagcccttaatactttgataattcaggtcataacttttgatcttgcaggcatcgccggaatttccctccaccgtataaacacggctgccatccgtaccgatcacgatacccacatggtctgctgtcccatccaaatcccaatcaaagaaaattgcatctccgggagccagattgttatagcctcttgcaccccattgtccatgagactggaaccacggaacgccctgccactcacagcctgcaaagcgcggctcactttttccagcctggttataacaccaggatacaaagcaggcgcaccactccacgcggctgtcaaagccataccagctccaataaggatagccgcccacattgccgacctgacgcttggccagctccaccaactgcggatttccgggacgggttccatttacaaactgtacaccggtcaagtcctcggaattgctcatgtcaggggaaccaccgccaaacaacagcggcttattgcccatggtctgccggtaaacctgatacatttccatctgctccggggtcagtaactccgacgccacagcggaaatgggcttgctggtgagtttcacattcaaaatgtaatactcataggggacttcttctgaggtggtctcgccggtctccgggtcggtggaggtctccgtgcggtagcgaatctccacttcctcagtaagcgtcagctgatactgtgctgcaaacacacgcgccagctctgcctgagcgctctgctgggtgtaaccttgcaagacggcagacagaaatgctgccagctcatgagggtcatggccgatcataccaaggtcatagcgatactcgtcataccctgggtggctgctttcaatgttgtcgatttcctcctgcaactggacttctctggctgcataatctgcctccactgccagcatttccgggtcatccgacggataagtagtgccggagagaacggaaccgatgctctgcgccatcatggagcaggaggacatggtattcatcagcatacaggtaatgaggaacaaaacccctgccatcaggaaacccttcttgtggcgcacgacgaacgcccctgcctgctgtgccttttctttcaccgtccttgcggcttttccggttttggacgcagcctgggcggtatttccggcagtctgaccggcgtgtttggcggcggcatactgccttttgatggccatgccgattttggaggacctttataacttgctgcgggagcaggaagaaaaagaagctcagtacattgcaacggcattggaaatctatgtaacgggttctttgaatgtgttcaatcatcagagcaatgtggacattgataaccggattgtctgctatgacatcaaggaactgggcaagcagcttaaaaaaatcggtatgctggtggtacaggatcaggtgtggaaccgcgttaccatcaaccgtgccgcccacaagtccacccgttactacatcgacgagatgcacctgcttttgaaggaggagcagaccgccgcctatacggtggaaatctggaagcgattcagaaaatggggcggtattccgacaggtatcacccagaatgtcaaagaccttttgagcagccgcgaggtagagaacatctttgaaaactcggacttcgtgtatatgcttaaccaggcaggcggagaccgccagattttggcgaagcaactggggatttccacgcaccagcttagctatgtgacccactccggtgagggcgagggcctgctgttctatggctccacgatcctgccgtttgtggatcacttcccgaagaacaccgaactttaccgcattatgactaccaaaccccaggaactgaaaaagaaggaggatgaatgatgatgaatcccaacattttgaataaaaatccgctgatgttttttgacagggcggtaaatgcccagcgcagccagctgcttacagtcatggccgatgcggtaagtgagtgccgcacggcggcagatcaggcagccgaactgaatgagaccggtcaggtggggcttctccgtctggcagaggtctggagcgccattcgtgctaaagaaggtatgggcggcctgattctggaaggaacagaggcgaagatcctgtccgatgtggtggcacagttttatgcctacctgtccggctgtatgtttcaacgatccggtgggaatggccatttatgcagagctgcactacatgatgtcctccctcatgctgggggaatggtttgaataaggaaccgcgtctgcgctttactgatgaggaacggtcctgaccctgcactggaaaagccgatccgtaaagcggagaaagctgcggccagagcagataaggcgcaggccaatatcccaaagaaaaaggtcaggcagacggtccattgacccagataccggaaaaaagacctcgaagctgacctttgaggacaagaaaaagccaccctccaaagtttctcaggagtcagggaagctccccgtccatctggttgcggcaagctccacaaagagatccgggaaaacagagcaggacaatgtgggcgtggaaagcgcccacaagtccgaggaagcggtggagaccggcgcttatctggtgcgggaagggctatcgcagccacaagctgaagccgtaccgcaaaagcagcacaggcaggagcgccaactggaaaaggcaaatgtaaatgttctgtaccagaaatctttgcaggaaaatccccagtttgccagcaatccgctttcccgctggcagcaaaagcaggccatcaaaaggcagtatgccgccgccaaacacgccggtcagactgccggaaataccgcccaggctgcgtccaaaaccggaaaagccgcaaggacggtgaaagaaaaggcacagcaggcaggggcgttcgtcgtgcgccacaagaagggtttcctgatggcaggggttttgttcctcattacctgtatgctgatgaataccatgtcctcctgctccatgatggcgcagagcatcggttccgttctctccggcactacttatccgtcggatgaccggaaatgctggcagtggaggcagattatgcagccagagaagtccagttgcaggaggaaatcgacaacattgaaagcagccacccagggtatgacgagtatcgctatgaccttggtatgatcggccatgaccctcatgagctggcagcatttctgtctgccgtcttgcaaggttacacccagcagagcgctcaggcagagctggcgcgtgtgtttgcagcacagtatcagctgacgcttactgaggaagtggagattcgctaccgcacggagacctccaccgacccggagaccggcgagaccacctcagaagaagtcccctatgagtattacattttgaatgtgaaacgcaccagcaagcccatttccgctgtggcgtcggagttactgaccccggagcagatggaaatgtatcaggtttaccggcagaccatgggcaataagccgctgttgtttggcggtggttcccctgacatgagcaattccgaggacttgaccggtgtacagtttgtaaatggaacccgtcccggaaatccgcagttggtggagctggccaagcgtcaggtcggcaatgtgggcggctatccttattggagctggtatggctttgacagccgcgtggagtggtgcgcctgctttgtatcctggtgttataaccaggctggaaaaagtgagccgcgctttgcaggctgtgagtggcagggcgttccgtggttccagtctcatggacaatggggtgcaagaggctataacaatctggctcccggagatgcaattttctttgattgggatttggatgggacagcagaccatgtgggtatcgtgatcggtacggatggcagccgtgtttatacggtggagggaaattccggcgatgcctgcaagatcaaaagttatgacctgaattatcaaagtattaagggctacggcctgatgaactggtaacagactttgtggaaaggagtgaacggttatggcaaaaaacaaaattgaacgtatcgaccaggaaattgagaaaacccgtgagaagattgtggaatatcaggaaaagctcaagaccttggaagcacagaaaacggaggcagagaatctggaaatcgttcagatggttcgtgcgctacgcatgactccagcacagctgaacgctatgctttccggtggaatgaaccacggcagagatacagcactgtcggaatcaaataatcaggaggctaccgcttatgaagaataaaagaatttgcaaaacactttccgccctttgcctgacaatggttgtggcatttggctttacgatccctgctttcgcacaggggtcagaacaggctccggcagcaccggcagaggattctaccaatgacagcaatgtgattgtggaagaaacagaaccggcaccggcacttacaccggaggggaatgcggcattggtggatgattttggaggcaataagcagcttattactgttacgaccaaagctggaaattacttttacatcttgattgatagggcgaatgaggacaaggagactgctgttcactttctgaatcaggtggacgatgcagaccttgtggcgctgatggaagatggaaaacccaaagaggagatgcctgcggtatgcagctgttcaacaaaatgtgaagcaggggcagtcaatacggcctgcccggtctgcgcaactgataagagtaaatgtacgggcaaagcaccggaacctccggcagaaacatcggagccggaaaaggagaagcctgccggattgaacccggctgcgatagtccttttgctggctctgctgggaggcggtggcgtatttgcctacttgaagctcgttaagaacaagcctaagaccaagggcaatgacagtctggacgattatgattatggcgaggaagattccgaggaatgggaaaccgaggatgaggagtcggacgagccggatgctgacgggggcagcacagaagaagatgacgaggacagcgtgaaatgacccgattcacagacagtccctatgaacgcatgatgacacgcaggccggagggcgggaaggaaacttcccgtcctccttctttacctcacagccacccctgctatggttgcgggaattatggaaggccctgcgtaggtatctgtcaccgggaaatgtcccgatggctcaaagagaggaggaaccatcatggctcaacataaattggtaattgccgaaaaaccatcagttgcccagaatttggcggcggtgatcggcgcaaccatccgtaaggacgggtatctggagggtaacggctggcgtgtcagctggtgcgtgggccacctggccggtcttgcagatgcagacagctatgacccaaagtatgccaagtggcgatatgatgacctgcctatcctgccggaacattggcagatggtagtgggaaaggataagaaaaagcagtttgatattctgaaaaagctgatgaatgccccggatgtttcggaggtggtaaatgcctgcgatgccggacgcgagggcgagttgatcttccgcagcgtctataagctggcaggttgcaagaagccgatgaaaaggctctggatttcttcgatggaggactctgccataagggaaggctttgcaaacctgcgccccggtgcggattatgacggacttcgggatgctgccctctgccgtgccaaggccgactggctggtggggatcaatgcgacaaggcttttttccgtgctgtatcaccgaaccctcaacatcgggcgcgtgatgtccccgacgctggcgcttattgttcagcgagaagctgagatcgacacctttcagccgattcccttttataccgtggcgctggagctgcccggtcttaccgtatccggggagcgcatggcggataaggccgctgctaagcagatgaaagaaacctgtcggggtgcaaatgtcacaatcaaaaaggtggagtgcaaggaaaagtctgaaaagctgcctgccctctatgacctgactactctgcaaagagatgccaaccgcctgcttggatttacagcccagcagaccctggactatctgcaaagtctgtatgaaaagaagctctgcacctatccccgtactgacagccgctatctgactggtgatatggcagacagcctgccggtgctggtcaatctggttgccaacgctatgccgtttcgcaaagggatcgccattacctgtgatccgcagacggtcatcaacgataagaaagtaactgaccaccacgcagtaatccctaccagaaatctcaaggatgcagacctttctgcccttcctgcgggagaaaaagcggtgctggagctggtggccctgcgtctgctgtgcgccgtagcccagccccatatctattcggaaactgttgtgattgcagcgtgtgccggtggagagtttaccgccaaaggaaaaacggtgaagcaccccggatggaaagcactggaggacgcttaccgtgccaaaatgaaggatgcagagccgaaaaaagagggcgcagagaaagctctgccggagctgaccgaaggacagaccctttcggttgctgcggcaatcgtcaaagaaggtaaaagcagtccacctcagcactttacggaggataccttgttgtccgcaatggagactgccggaaaagagaatatgccggaggacgccgagcgaaaaggtctggggacaccggccacccgtgccggtattttggaaaagctggtatctgccggttttctggagcgaaaaaagaacagaaaaacggtgcagcttcttccttcccacgatgcagtatcccttatcacggtgctgccggaacaactgcaatcgccgcttctgactgccgagtgggagtatcgcctgggcgagatcgagcgcgggcagcttgccccagaggagtttctggatgggatcagcaccatgctgaaagatctggtggggacttatcaggtcatcaagggaactgagtacctgttcactccgccccgtgaggtggtgggcaaatgccctcgctgtggcggtgaagttgcagaactgcaaaaaggcttcttctgtcagaatgattcttgcaaatttgcaatctggaaaaacaacaaatggtgggctgccaagaaaaaacagccgaccaaggctgtggtgtctgcgctgctgaacgatggccgtgtccgtgtgacggggttatattcggagaaaaccggcaagacctacgatgccactgtggttttggaggacgatggacagtatgccaatttcaagctggaatttgaccagcggaaaggaggcagccgatgaagctctctttagtggaacgggaaaccattctcctctataaccaggcagaaccaatggctgaggtctatacccacgatccccgtctgatggagaagctggaactgctggcaaaaaagcaccccgaccagatcacccgaaaggacgcccataactttaccgtccccaagcggtgtgtatcagtccgggagccatacagcgccgagcgtcgcaaagctgccagtgagcgtgcgaaagccgccggataccagccccctgtgaaaaagtccggcagttaaaggcacatggcagagaatgtatttgaagcggtcaagcagtcggtcagcaccagagaagcggcagagttttacgggataaaagtcagtcgaactggtatggcctgctgtccttttcacgatgataagaaccccagcatgaaggtagaccagcggttccactgctttggctgcggtgcagatggggatgtgatcgactttaccgcaaagctctttaaccgctccccaaaagaagcggcggagaaactggcacaggactttggcctgatctatgacagtcaggccccgccccgcaggagatatgtccggcaaaaaaccgaggcacagaagtttcgggaggatcgacagagctgttaccgtgtactgtccgattactactatctgctgaaaaaatgggaagccgaccgttctcccaggacaccggaggaagaaccgcacccccgttttgtggaagcaatccagaagaaagcctatgtagagtacctgctggacctttttctttatgaaagtgaagaagaacaaaaggcatggattgcagaacacacagcagaaatcacacacttggaaaggagattgaaaatcatggctgagaacaaacccaccaaccgagaacggctaagggaaatcacagatggtatcgagcagggcatcaaagaactgtttgagagtgaaaagtatatgcgctatctgtccgtcatgtcccgcttccaccgctattcggtaaacaacaccatgctcatctatatgcagaagccggacgccacattggtagccggatacaataagtggaaagaccagtttgagcgtcatgtaaaaaagggcgagcatggcattaccatcatcgcccctacaccgtacaagaagaaaatcgaggagcagaaactggacccggataccaaagctccgattctggataaagacggaaagattgttacagaggaaaaagaaatcgagatccccatgtttcgcccggtcaaggtctttgatgtgagtcagaccgacgggaaacctttgccggagcttgcttcctccctttccggcaatgtgccaaattatgaggcattcatggaggccctgcgccgcagcgcaccggtgccgattacttttgaagcaatggccgctgatacggacggctatttttctgctgatcatcagaaaattgccattcgccaaggcatgagcgaggtgcagacggtttcggccacggttcatgagattgcccacagcaagctccatgaccctaaaaaatatgaaatgctaccgtcatggaaggttgtgcaggagagtgaaggtggaaccaagcatgatttcaagttggattttgccacagaaaaagaagccgaacagtttgcttctgatatggattggcgttatgtggacgaaaatcagtttgaatggcgtcttgcagttgaggaagatgcaaccgcagaaaaacaggcaatcaaaaaccgccacacggaggaagtggaggctgaaagcatctcctatgcggtctgcaagtattttggcatcgagaccggagaaaacagcttcggctatattgcaagctggagccagggcaaagagctgaaagagctgagagtcagtttggagaccatcaacaaaacctccggcactttgatctccgacattgagcgccactataaggaaatctgcaaagagcgcggaatcgaccctcatgcaaaggtagagccggaaaccgccccgatagagcagccagcagatgccattaaggtatctgataggctgccgaccggcgatctgacctactatgtagcagagtgcatggaatttccaaacctcggagaataccacgataatctgtctttggaggaagcaatccgcatttatcaggagattccggcagaacgaatgaacgggatcaagggcattggttttgagctgaaagacggaagcgactatgaaggaccttttccgattttgaccggccagaccattgacctggacaccatccaggcaatcgactattaccgtgataatcctctggtgcaaaaagcggtaaaggaactggctgcggcaatgccggaaatggaagtgctgggggcggatgccaaccagcaggaggctttgtttctgattgacgatgccacctatcttcatatccagtcctgtgacagcggctgggactataccctttacgatgccgcgtccatgaaagagctggatggtggtcagctggatatgccggagatttcccgcatgaaggcagttctccagatttgtgatgacaacgatttgggcagagactcggtaaaatacgcaccgttgtccatgattgagaccttgcaggaagctgcctaccagcagatgcaggcagaggtcagtcagatggctgcttcttcccagctgccggaagcacaggagcaggcactggatgaataccccatgccggatgagcagatctccacatcagatatgcaggaatacggctactcctatgatgggatgttccctgttaccagagaacgggcgctggaactggatgccgccggtttgaccgtctatgtgctgcatgaggacaatacggagagcatggtgtttgacccgcaggaaatcatggatcatggcggtctttttggcgtggaccgtgaggaatgggagaaaagccctcagttccacgaaaaggtcatggagcgtcaggaacatcagcaggaacgcgaacaggcatttctatcccagaacagagattgctttgccatctatcaggtgagccgtgacgatccgcagaatgtgcgctttatgaatctggactggctaaagtcccatgatatttccatagaccgcagcaattatgacctaatctacacagctcctctgagtgagtctggcactgtgctggagcagctggaaaaactctatcagcaattcaatctggaaaaacccatggactttcacagcccctccatgagcgtcagcgacatcgttgcgatcaggcaggacggtaaggtatcctgtcattactgtgacagcgttggttttacccagattcctggattcttgccgcaaaatcctctgaaaaatgcggagatggccgtggaggacgattacggcatgatcgacggtatcatcaacaatggcgcaaaagagcctacggtggcagagctggaacagcaggcccgaagcggtcagcccatttccctgatggatctggcagccgccacccatcgggaggaacgggaaaagaagaaatccgttgtggatcagctgaaaaaccagcccaaagcagaacacaaaaaacagcgccaaaaaagagtgcggaaagggagatttgattatgggaaactttacttttgaggaaatgaacctgatgtgcatttacaataccggcagccgcaccggattgatcaacagcctgcgtgagatgcgcggcgagctatcaccggaggaaacggaactgagggagctgaccgacagcgcccttacgaagctctgtgcgatgaccaatgaggactttgcccagctggagctgtacccggattttgaccagtaaacaccataaccgcagggatggggtggcaatttgccaccccacctctttaccccaaaaccgaaaggaggacagaacaccatgccaaccaaagctgaactatatgcacagatggcggacaaggtggcaacgcagctcacggggagctggcaggaatgggcagggtttctcaccactgcttcccgactttacaaatacccgttccatgaacagctgatgatctacgcccagcgaccggacgccaccgcctgtgcagagtacgatttgtggaatgaaaagatgggccggtatgtaaggcgcggttccaaggggatcgcgctggtggacgattccggggacaggccccgcctgcgctatgtctttgacatttccgacaccggaacccgtgaacattcccgcaccccctggatgtggcagctggaggagcgccatctggattccgtgcaggctatgctggagcgcacctacgatgtttccggtgatgaccttgccggacagctcactgaggtagccggaaaactggctgaggaatactggacggagcatcagcaggacttcttctatatcgttgacggttcctttttggaggaatatgatgagtataacatcggagtgcagttcaaggcagccgccaccgtcagcatcacttacgctctgatgtcccgctgcggactggagccggaacgctacttcgaccacgaagatttcatggcgatctttgatttcaacaccccgtccaccatcggggcgctgggaacagcggtcagccagatcaaccagcaggtgctgcggcagatcggcgttaccgtccgaaatgcagagcgcgaagccaaccaagaaaggagcaaacaagatgaacaatcccatgacctatatccagaacggagactatctgattcccgacctgaagctgagccagcagccggagaaacccctgggcaagtacggcaggatgaggaaaactacctgaaggaacatcgtcccatcctctacaaccagatgttgctgagcgagaagtgtaccagcaccttctggagatcgacgagaccgcccagagcagactggagcagatgatgccccagctggcgaagaagcgggagccaccgaggaactgaaagccagcgatcccatgaagtgggtggggctgatgaacacctgcaaagctcaggccgaggaaatcctgatggcggagcttatcaacagctgactctaaacctgttcctctccgaagcggaacagatccaatccatagatgaagcagagaatgtagcgcatacatcctctgctttttcttttgcccaaaatgatattgaccatgtgctgcgtttgggcggcaatacagaccgtcaaagggagcgtgtgttgcagcctttgaaaagcagaaaaccaccgctgagattgccgagatactgaaaacgctgtaccacggcggcaacggccttggcagtgtgagtgcatggtatgccgaggatggtatccatctttcccatgggaagtctgtccgttatgacaggtctgccaggtcatttcctgggagagcgccgcagagcgtatcggggagcttttggaaagcggccagtttgcctccaatgtggagcttgcagaagcggcaggctatgaacgctccctcctctcgaaaagctctggcatctgtatcacgatctcagtgaggacgccagaaaagccggatatttgtcctgcctgtcagagatcaaaggcaatggtttcccgaggagacccgccgcctgacggagcagctgagtgaccggctttccgccagaccctcaaggaagaatacgctgccttctggactgcctatcagcaggaccgtgacctgttgcgttttcactatcagaccgagggagatctgggagaacctgaaggacttgacctgcccgcaggaccttttcttcagagctttccaagtgccaaccgtccagcactttattaccgaggatgagatcgacgccgccatgaccggcgcagtttcgccggaggaaaaggccgtatctatgcgttcttcatggaaaccatacggataaggagaaagtgattcctcaaagacgagtatggcattggcggacgctctcatgccttgtccggtgcaacacacagcggcgaagatcacgggaaaggactgcactataaaaagcaggactgcccggatgttcacttgaactgggaaaaggttgccaagcgcattacctcacttgtccagaaagaccgctatcttaccgaacaggaacaggtgcagtatgacaaaatccaggctgaaaaggaactggcagaagaagatgccattcaaacacagcagccggaggtggagaagaaacaccaaagctacccttggggagcagtttgagcagtataagcctgtggtgactgccgccatttccgaggataccgcatatcgcaatgcctgcggtcattctgaccgtgaaaatgctgtcatcgagggcaatgctgctgtgcgccgtgcggttcttggttctaaggatatggagctgatccgactctattcggatgtgccggagttccgcagcgttgcaccgggaagtgatcgacgagacctatccaaagctccatgagcttctgcgccctctttctcaggaagatattgatactgccctttgtgcatggaacggcaatatcgagagtaaacacgctgttgtccgctatatgaaagaccatgcaagagaaaaagataccgccgcatggctggctcaggaatacggcggcagtaacagcaacagcctgttcgttgtccgtgccggcagcccggaggaaacgcagctgccctggccgaaggtacagcgccggcttgcccagctcattcaggaggaccggttctataccgaagaagaacaggaccgttttgacgacatcgacccaatcgccatccgggaagctctggagaaagaggatcgtcaacggcaggtggcagacccggaaaaactggacaatgatccgtttatccaacaggtgatgtcagatgcagcatcgcagatgccgagacagacagacttccaaagtttccatttccgatgaggaatatgacgcagttcgccgcccaattccgcaaagaacctcctatgacccagccgccctggtctatgccgtgggcgataccgtgtatatcgaggatgacgcctatcagatcacagagctgcggaggacaccgtacagcttctgcccaccgggatggtatatcccatctaccgggcagagcgcaaagaacagttcgagcagctgcttcgggcagaccgccgcaatgcttactataccgagtttcttcctactgacccggacaaggcagatcaggacttgcgggatgtattggctcatggattgatggatgaagcggataaaaagcagatttcacgctgctgcaatccggcaggagcaacagcgagatcgcctactggctgagcagagcctattccggtgagatcgagacactgaatctggagactggcgatattgccgattaccgtaccacggcacagggcatagagctggaagtcatggatgcagaggaaaagcgtctggctatgctgtatttccgctgggatgaggttgcgcctttgctgcgcgggatgtatgcccgtcagcaggacggttttggacaggaacagccccaaccggctaccgaatccccgaccttccattccgagaccatggccgtctattcgggcgataagaacaatctgccttatgatgtggtggtggaacgactgcatatcgaggagccggagccgccagcccctgtgactgagccggagaaaacctttgaggaagtgctggacgaacacccggtttccattcaggtcaatggccagtggcagacctttcccaatgccaaagctgccgaggaagcatcttatgaggaatacaaggctaacctgcgcccgcaatgcaaaaaacttccgcattacagatgagcatttgggtgagggcggtccgaagccaagttccaggcaaatgtcaatgcgattcgtttgctgaagagctggaagctgccggacagcaggcaagccccgaacagcaggaggttctttctcgatatgtgggctggggcggtctctctgatgtgtttgacccggagaaaccggcatgggctttagagtatgcccagctaaaagaactgctgaccccggaggaatatgccgccgccagaagctctaccctcaacgcccattacaccagccctacggtcattcaggccatctatgaagcggtgacgtatgggatttgagaccggaaatattctggagccgtctatgggtgtgggcaatttctttggtatgctgccggagaaaatgcgaaacagccgtctgtacggcgtggagctggaccctgtttccgggcgcatcgcaaagcagctctatcccaaggcggacatcacagtaggcggctttgagaccaccgataggcgtgacttctttgaccttgccatcggcaatgtacctttcggtcagtatcaggtcaatgacaaagcctacaacaagctgaatttcagtattcacaactatttttttgccaaagcactggatcaggtgcgtccgcggcgtggtagcttttgtaacctccgctatactatggacgccaaggattccaccgtgcgccgctatcttgcccagcgtgccgagctgctgggagctatccgtctgcctaatgacgcgttcaaaaagaatgccggtgccgaggtggtatcggacatcatcttcctccaaaagcgggaccgcccgttggacattgtgccggaatggaccaaccggacagacggaggacggtttgccatcaaccggtattttatcgaccacccggaaatggtgctgggcagacaggagccggtaagcactgctcatggtatggactacaccgtgaaccctatcgagggactggagctttccgaccagctgcatgatgcggtgaagtatattcatggcacttatcaggaggcagagctgccggagctgggcgaaggcgaagctattgacacctccattcctgccgaccccaatgtgaagaactattcctatgccattgtagacgggcaggtgtactaccgggaaaacagccgtatggtgcgccctgatctcaacaccaccgcagaagcccgtgtaaaaggtcttgtgggactgcgtgattgtgtgcaggaactgatcgaccttcagatggatgcagcggttccggacagcaccattcgggagaagcaggcggaactgaacagcctctatgacagcttttcttccaatacggtctcatcaatgaccgtgcaaaccgtctggcctatgcagacgattcttcctattacctgctctgtgcgctggaagtcatcgacgagacggaaagctggaacgcaaggcagatatgttcaccaagcggaccatcaagccccatcaggcggtggctgtggtggatacggcaagtgaagcactggcggtgtccatctcggaaaaagcctgcgtggatatggactatatgagccagcttaccggaaaaacaaaagaagaactggccggagagctgcaaggcgtaatcttccgtgtaccgggacagctggagaaagacggcacaccccattatgtgactgctgatgaatacctctccggcaatgtacgccgcaaactgcgtcaggcgcaacgggccgcacagcaggacccgatttatgcagtcaatgtggaagctcttaccgccgcccagcccaaagacctggatgcgtcggagattgaggtgcgtctgggcgctacctggattgacaaggaatatatccagcatttatgtatgagacctttaataccccgttttatctccagcgtagtatcgaggtcaactattcgtcctttaccgctgaatggcagatcaaggggaaatcttctgtatcctacaacgatgtggcagcttataccacctatgggaccagccgcgccaacgcctacaagattctggaggattccttaaacctgcgggatgtccgtatctatgacaccatagaggacgcagacggaaaagagcgccgcgtgctgaacgccaaggagaccaccctggctgcccaaaaacagcaggcgatccgggaagcctttagggactggatctggagagacccggagcgtcgccagactttggtgtgccagtacaacgaggaaatgaactctacccgtccccgtgaatatgatggcagccatatcacttttggggcatgaatccagccattacccttcgggaacaccagaaaagcgctatcgcccatgtgctgtatggaggaaataccctgttggcacacgaagtaggcgcaggtaaaacctttgagatggtggccgctgcgatggaagccaaacgcctgggactgtgccagaaatctctctttgtggttccaaaccatctgaccgagcagtgggcgtcggagtttctgcgtctctatccttccgccaatatcttagttaccacaaaaaaggactttgagacccataaccgaaagaagttctgcgctcgtattgcgacgggtgattatgatgccattatcatggggcacagtcagtttgagcgtatccccatcagccgggagcgccaggaaaggcttctctatgacagatcgacgagatcactggggcatcgcagaggtgcaggccagcggcggcgagcgttttaccgtcaagcagctggagcgtacccgaaatctctggaagccagactggaaaagctgcaagccgagggcgaaaagacgatgtggtaaccttgagcagctgggtgtggaccgattgttcgtagacgaggctcacaactataaaacctgttttatatacaaaaatgcggaatgtggctggcctttccacatcggacgcacagaaatcctccgatatgtttgccaatgccgctatatggatgagatcaccggaaaccgtggcgtgatttttgccaccggcacccggtcagcaactccatgaccgagctttacaccatgcagcgttaccttcagtatgaacgcctgcaagactgaacatgacccacttcgactgctgggcttcccgatttggagagaccgtcacagcattggagcttgcccggaaggaccggctatcgggcgcgagattccaagtttttaacctgccggagctgatgaacctgttcaaagaagtggcggacataagaccgccgaccaactgaacctgcccaccccggaggtggaataccacaacatcgtggcgcagcctaccgaacatcagcaggaaatggtcaagaccctttcggagcgcgcatcgctggtacacagcggaaccgttgacccgtcccaggacaatatgctcaagattacctcggatggccgtaagctgggctggaccagagatcgtcaaccagatgctgccggatgaacctggcacaaaggtcaatcagtgcgtggacaacatcatgcagatctggcgggatggcaaagctgacaagctgacccaactggtgttctgcgacatttctacaccgcaggcaaaagctcctgcaagcaaggcggcgaaaacgctggataatccactgcttcacgcattggaaggcatcctgccagttgatctgctggattgtcttcacatgaaacagtccgacaaccagcaggaaaacaggcaggagtgacgctatcgtaaaatgaaagactaaatctttaccagatgggcgaatccttttaccacgctgtttcatgcgaaaaagtctcctttctacctagcgactatttgtcttgtgtcggttctttctttgcttgtggttgagctttgaatgaactagaatcctttgtcagcacaatatcgtctgccttgatataccagtcaacatctgctccttgataggtggcagtagcaacggtgtccgcaatgggattgataagttccacccgtgcgttataatcaaactctttcaaaggcacgctggcaggaatacttacttgaatcatgcgtccttgtcctttggattttaagtcataggtacgttccttgatttcatctgaaaccgacccgtcttcattttggattctcacttcacgacgtagagcagagaatttcaattctccaaaagtcgtgtctttatctaatacaatgccatttgctaatctcatcatttttcctctctttctttattcttttatcatgtcgtcagcatgtaaaaggtaatttgtaaaaccacgagtgccgattttgtagccctctgcggtaatacgtggattgactaacttcacacgttcctcaaagccgaaatgtttttcgccagcttcagcaggaagcaccaccacaatatcatctgctctttgaacatcagaatagagattatagcttcttgataagacagttagccgtccgttgattcttcgctgaacgactttatcctcgccagcaaattctaaattgccgaatgttttttccatgttgggaatcacaaatttaagttccatatttttacctatcctttcttttttattggctgaatgaatgtttgatggtcttaaagagtggggaacgaccttttgattcttgattttttgttttcataagttcacttcctttcaaaatcgggtaaaaaaatagacacctcattttttgaagtgtctacctattaaatattcaaattttattggaagtatctttatatcttcacttttcaaggataaatcgtcgtatcaaagctcattcataagtagtaaattagtagtaaattgagtggttttgaccttgataaagtgtgataagtccagtttttatgcggataactagatttttatgctatttttatatgaaaaaaatcgtaatagaaccaaatgagattgaagcagtaaaaatattacccaatcaggatatgatcactttatttacctgtcatccatatgggatggaaacacaacgctatgttgtttatgcgagcagaaaaagcatttacaacgatattgaattaccaaaaggggttacgtatacatcgtctagaaaagagattgcgatagaaaaaacgttaaacaattgtctattgtttgcttccggcttgcttgccgtgattctgataatcgaaagcattcggatgaataaaatgtgaatcgtactgtcttcattttagtattgcgtatgggagaaaagaatcaaggaaaacaacaatgttttattagcatagttttgtccacaagagatagaaatatcgtaagtaacctagaaaatatcctgaatataaaacacttaaaaagacacgattcaaatattgccttgccttaagtgttgctgctattatcaaattatcaacaaaaacatccgatgatgtaagataattcaataatgatttacaatattgcctgtttattatacattgaataggctatatcaaagagagggttcgcttatagaaaagtaataatgaacaatttatcctgtttgtttgacgctataaataaaggataggaggtaaaggaatgaaggatttttggaaaagaattttagtatgtattgttgtaagtgcaatgttctttacatcaacaggttttggaatttttcaaattgttgcaagcatcaataatgcttctcctattgaaaacttttcgattgaatggaaaacacaggctaatggtaaaaatattatttacgatgaaaccgggacggttgtcacattgaaaccggagtttaatgatagggatgctgcaggaacctcaatacaagcagaagtgcatttgtccttgagtgaagcggcaaatatttcagaaaaccaattagagatacgattgccaagtactattttttataacagaagccaagcagcatgcggcgaatatgaaataggttttggttcgggggcgtctgatggaagttttgcttatcgtgttgatgaagaaacaggcgagcttgtcgtttataatacatctgttatcaatgatgcaatggttgtaaaatttgatattttatataaaagcggacttccaagtgagatagttagaggatatgagaaagagttaagtgcaaatataaagattttcaatgatgacagttctattgattatgaacaaataacaaatcgattaacattaacatatcaaacggagtcagatattcatcgtgttgaattaactaaatctaaaaaatatgaaacatggaataaaaaatggggagaagaacccgaagatgcaaaggactattttttcgttgaatggaaaatagacacaaccgtacgttctacatcatttacaatgccttttaaattgatttttacagataccttaagcaatcaaggagaggtagtaggatggacagattatcattggggaatggatatgataatgaattctaaatattaccaaagtgatcatccggtctttcaaattgatgtaactaaacctagtaaaattaagaattctgactcctatgattttcatatcggttatgtacttataaagtatccaagatcagaattagaaaacacgaaagaaatcaaaaatgaaatcacggtacggttagagaatttgtatccggaagatggcagctattccaaggaagtaaaagatgatgcaatgtatacctatgtggatataaactttcgctatcccccaggcaactatggtttggaaaaggagtattcaggcggtacaagcagtcaattgcttggatacttatacgccatagaacaagctgctgttaatgcaaaattacctgctactaatgattttagaaatacttctactgctacaggcggtattttaacattagacggagatggaaataatatcgagaattatggtaaaaaatcatattctgtagaggtgactgatgattttgtagcattagaaaatgagcgattaactgatggagaatattatatttcatcgattcaggtaactgatgagcaatataattacaagatgaacgaagaagacggaagtggtggtgtagaggaagataagaactatgatgaatggacaccgattaccatagaatatcagcaaggaattcatggtgaatggaaggaattagtaacgggaaagccgtttactgatcgaattagcagaaaatcatatcaccttagtttcccggatggaacaacaaaagattacggagctatatctgtaaaagaattaccagaaggtacgacaggagtgcgagctaaaagagaaacaaaatatcataaaagtgatcttgatctcaatgtaacaatcggcttatatgctacagataaaatcaaacaaactgcactgaataaaacatctttaacgttaacgaatatcagcacatatgttgttaaagacagcaatcagagttgggtaaatccttatgcagagatgtctataggagggacattaaaagatgaagtaatgaagcgtgataaattagtttttggtaataacgatcaatacggacaacatgatagagccgctgttacattaaaaaatcccatcttgaaaaacaatataactaaagaagcttctaaggtaattaatgaaccgtccaattctcgattcaaaataaactacacaataaccggcggcgagtacttagaccgtgaatttggtgatgatcctttttatgctacaaaagaggaactgaaaaatacaaatatggtaaaggagcaaagaagtgcgatattttatgatttgttgccactaggtatgtatgctgattattctagtataaaaagctatgcattaaaattaggaagctatggtcgtactctgaaaggagaacaatttgagcatacagtagaaactattgataattataagggcacagggagaaccatgctgattcttcatatcacagtgcctgaaactatagaaaacctattctacgaggcaacttatggcaagtttggcacaggattttatataacttatgacgcatattatccttgggaatcccttcttgactttgggaatataccattgaatagcgtagcatataaatcaggtgcgggagaaatatttaaaggttttgcagatgatggcggtgacaaaataactgacaaagatatacttaaagatgttgatgaggatggaaaatttggcggtgatctcgttaaggatacattatatgcagaagcgcgggtacaaataagcggcgttgtaaattcagagctttctttcagtaaacgagtaaagtccgatggggatatcgcttattcaaaaaccacttcaacaataggtggaggagcctattcttatcagctgagaataggtaatgaaaaaaatatcaaaacgaagggtcttatattctatgatatcttggagtcagattttaaagatcgtgaatattggcaaggaacgctggtaggagtggataccagtcaagcgcagctaaagggaatttcacctgttgtatattattcaacaaaagataacatgaaattgtcgtcaagcatgaatggcgagatgatcgatgacgccaatattaacgatcccaccatttggagcacaacaccgccaaatgatatggcggatgtaacggcaattgctgttgatttgagtaaagatactagcggaaacgaatatattttagacagcgagcaaactgtattgataaaaatattgatgaaagcaccaacacaacatgtaaaggaatacatagagaaagatgcgaaggcctataatactgcatgggttcgtaatcaaacgttgttagccagcggtggagtagagaaaagcgaaaccctgcaaacattagaaactgtagtatccttacggaatccggatatagaaattcataaaaaaagcgatccagaaacaggaacgcttgatgctccaacacaagtgaaaaataatgatatattgacgtatgatgtaagcgtcgaaaataaggaaaatgctatacctttgaaggatgtttgtatagaagatcccataccacaaggtttaacgattgattttgaaaatataaaatggtatccaggaaatgacgtatcacaaatgaagctggtatctgaatcagatgaagtaagtgttacaagagataagcaaacattaagatttaaaattcttgcgttattagccggtgatgttgtccattttgtaatcccaacgactgttgatgagtcagaggatgcagtggttttcataaatcaagcgaaaataacgaatataaacggcgctgcatatgaaaaagaaagtgagattacgtatcacgaaaagaaatcagaattggtggattttgcctttatgaaaacggataaagacaaaactgtattagcaaatgccggttttgttctctatcagttaacgtgtagtgatgcaactcacaatcatgcagatgaattattaaaggtaaacgatgatggagaactaagcgggcagatacaaacgaattgctggaaacaagttgagaaacaagtctcggatgagcatggaaatgtgagttttcaaaacttaaaaaagagtttggaatatcgtttgattgaatatcgtgctcctgaggactatgttttaccgaacggacagtggattttacattttgattatgtaaaagatgcatttgaaataaacagtatacatagaccaccagcttttgaaattcataacggtgtattgattttggttaattacagacttggtgaaataccgattaccggaaattcaggtacacagagtatgctgtttactggtgcggctttcatgttgatcgccggaatctggataatatataaaaagaaaacaaggaaggaaaaaatataaaatacgtcaaagatatatattagtaaacagcaatcgccgacgaagtgcaaaagcacaggataagtatacatcaccatcctattctctttgctctggatgaggtaatttattgattatgattctgcggcatgaaaattaatacacacttggaaacagatagaaaacgtgatacctatatcgttctgcttttttccttttaaaatgtccttattgcggaagtcctcattatcgttattgggtgttagaaaagcgttctgccatttagaaaaaagcactttcataagggagcagaataaaaaaacgtatatgctgctgattaaaaagcaatgtatacgtttttatctttggaatagtgttttttgtattttttttggatgagatccgaaaactgttctgatatgagaaagcatatatggaacaaggatacgattataaagaaagcgaaaaacaacatcagaaagagcagaaaccgatccttgatgaacgtttcgcatacattaacaaaagacagttagagtatgcatcaaaattgaagatgggaaaagtaattacatatgcaatgcgatatgtcggtcgcccggctatggcagaaagcagaatcatcaaatattcaaaaaccgaagataccatagaatggttttaccatgatcacaaagatgaagtaaaacatattgtaaaagaagactctaaatcatttataaaaaaactccttattcatatccctgatgagaattttcgctctgttcgttactatggattctattcaaacaaagcaggagaagaactggatcacgttcatgaactgttaggtgataaaaagagtagagattattcaaaagaaacacggaaaaagaaaagatgttaaataagttaaaatatcgtactcaccttattgactcttttaatcgagaccctttaaaatgtagattggtcactatcttgaatataaagatacatacagccctttggaaggagtaacagatgagcgattataccgaaaaaagtgtatcgatgaaatgcaagcattgcggatacgaagaagatgttccacagtgggttcttgatgaattaaatgaatttagtgatgataaatcctatcagatgatttgtccagaatgtgatgatacgatgtttgaaaaaggaacattaagctaacattcatactcttgtttttagtgcgcattttttttggaaaaagaactttatttgattaccaaagctctttttcttttaatccatgacgcatcgaaattcttggaatatcaaaaaagcaaaacattcaactgtttcgcctttcatagatctttttgtaattatagaatttattaacatcttgtgtaacttattaacgttccatgccattctttttctaataaagatcgccaatcattttatcaacatatgcattgtaacgatcttacgcatttaaacaagtatccatcagatatgcggtatctgttttgaaattttccaagccacgatagtagaaacttttatgcatatcttcgataataaatagaacgatatcatgctttaaacactccttaaacatgaccattctaccaaccctaccgtagccattctgataggaatggatgctttcaaaacgataatggaaacttatgattctttaaatgtcacttttgaaattacgttatattcttctaaaagagaagtgatatctgcttctacaatctattctcatatgagtttaaatacccagttcctgtctataaatattagctaattgcttagtatatcattagtataattgccttattgaagaaatatttaattttcatccatatgcgtcaggctttatgacacagcctgttagcatccattttttacgagcgcattatagatatatgactgcttttcggtatcacagtcttatatgtgatatcgaatggtatttttttcagtaactgatttctgtctaaaactgtattggcatgaaacttgctggcattatagacggaggtgttacaatgagagaagtactacgtattatagcagggaacatatgtataacaggggcgtatgcattcatcactgttccttgtcatattgtaaacggaggaatcacatctttttctatgatccttcacaatttcatcaatatggatatcagcttttttacaaacgccataacaatactactgcttattttatgttttttccagctcgggaaaagctttcttttaaaatctcttctaagcagtatatgttatatgctttttttcagtatcttttatgcactgaacatcgtttttccactccctatgccgcttgcagttttaatggcgtctgtaatggtaggctttggctattatttatgtatcagttccaattccagcacggttggttttgatgttctggcaattatcctgcacaataaaaacgattccttccctattgctgtaactatgcgatatatcaatgtaattgtggtcttgcttggttttgcttcttacggctggaaatctgtattgattggaattgttttcacctacttccagacacaacttttacatttgctgctgaagcgtcatgaaaaaatgatacagtgtggaaacaaggttacggcatctgtatcaacgtgtattgtagaaaatgaaaggatgacacaatgaaatacggcataaccacagaggagctcagcaggagctattgcgaacagaaaattttgaaggtttataaagaaattggatttgatgcagttgattacagttatgatattcacgctgttcccaattcagtatatgatcaagatgactatctcgattatgcgaaaaacctgaagctggctgcagttgaagcagggatagcgatacatcaaatgcatgcgccattatatcatcggcgtattgatatgccgttaacaaaagaagatcagcaggaggaaaagtttcttaaaaaaatgacgaagcgcggttttgaaatagctgaaattctgggatgccactatatggtaatgcatcccagaaaaatgcgtttttatgatcaaatcggtgcgaaagaaaaggccagaagctataatcttcagatgttcagagaatatgaagcactggccagaaagcatcatgtacaaattgctctggaaaatatgttttcctatcatccacaaactcacatgccagtcgatacggtattccgaacagcagaggaaatcgtatcctatctggaagaattgaacagtgatgtgtttgtagcctgtctggataccggacatgcgaatatcaatggaatttcagcagcacacatggtgaaggttctcaatcagcatttgaaagtattgcatgtacatgataattacgctgcattggatcagcacctgttgtgtggatacggcaccattgactggaatgcattttcacagtcacttcatgatatacgatttgacggcgtaatatcactggaaacctctgcaatgtgcacacctcttccagaaatttcctgtttagattatgcaaggctggcttttcgtacagtttcaaatcttgtaaaataagagaaggtaatacatacaggaggtctaaagatgcgaatagataaaatcatgagggttattgatgagcattgccaaaaggatcggttaaatgatatccgacagaatgccaatggaatcagtgtatatgaaattgcggaagccctgcagctcttgcgaaacaatgtaaatgcagatgttaataagctttttcaggaaggcaaggtcattaagatatgcggagataaaatctatcgattttattcacaacagcatttttcaaagataacgggaaaacatctacagccacagaccacttgtaactatctgcaggaattacttgaagatatgcagggaagcaatgatcaggacgacccgtttacacagctgattggctttgacggaagcctgcgaaacgccattctttccgcaaaggccggcatattgtatccgggtggagcacttcataccttgttgttgggagaaagcggtgtcggtaaaagtttgttcgcagagaaaatctttatgtatggtaaaaaacatggaattttcaataaagatgggcagttcgttgttttcaactgtgccgattatgcaaataatgcagagttgctgctctctcatcttttcggtagcataaaaggcgcctatacaggtgcagacagtacaagagaaggtctgttgaaacgctcagatggaggtatgctgtttctggacgaagtccatcgacttcctccggaagggcaggaaatgctgttttatttcatagataaaaagaaataccgtatgctcggagaagcaaattgcgagcattcagcgaatgttgcccttgtgatggcaactacagaaaatcccgataaccatcttcttacaacatttttaagaaggattccgatggtcattaaaattcccagtctgaaagaaaaatcactgcaggagcgtgaacagatggtcttatatctttacgcactggaggcagctgtcatctgttcagatattatcatagataaagatacaatgacagctttgatactgtatcatcctaaaggaaacatcgggcagctgaaaaacgatataaagctttccattgcgcgcagctatcttgaaatgcgcaataataaagaaagtgaattgcatatccgtaaatacacactttcacatcaggtaagcgatggtcttatagatcaggatattgagcagcgcaaagaaatagagaaaatgctgattcgagatacttacacggtaacaccattccgtgcagaacctgctgtgatgccggcatcaatgtttgaatttcctgtatttgacacaacgcaatctgatattcagacttcatttgaagaatacgttgataagattgccgcatcactggaacaggattcgcctccttcttttatcatagacaatgaaatacgtgaaatcatgactttcatccatgaatggattctacagaatatgcaaattttaattgagcgaaggcaaagtgcagctctggcattttatttaaaaaacattcgtgattatcaaacaaatgcatatcttcatgatgaatacactttggaatgtgaaattgcatatattgagaaagcccgctcacttatccgctccattgaacagcggttcaatctacgcataacaagcgaaggggttcataccctcgcctgtattttgaaaacattcaaaagcaattcatccgaaatatgcagcatcagtatgtttgttgttgcacatggaaattcacttgcgacaaatattgcagatgttgtgaatgaactgctttctattgattatgtaattgcacaggatatgccgcttacgaaaaacgtaaaccagatcatcgaagaattaattgaaaaaatctgtaaagaaccgcttcaaaatgatattgtacttttcgtagatatgggttctctcatgtctttggaagaaacactgcttcagcgctgtaactataacatcgtcgtaatcccgacggttcatacactgcttgtattagatgccgccagaaaggcaatgttcatgcagtatccgctaagtaatatcctacatgatgttatgcgaatgaatcagaaggtggatcaaacgctggagcatcatatccgcagtcatatcggtcaatacaatgaaaaaatcatatataccatctgctattcaggtgatggcacagcgcactatctggaaaaatacctgaaggacatgatggaacaggctggtatcttcaacattgaaattctggcattaagcaatgattctttaatcaaaatacgaagtattattgaagaaacctcaaagcacaaagaggttttatgcataattggtaatgttgatcccggtgtacatgaatatccgtttatttccatagaagatattttgctgggcgatggtgtaaaacgtctgttcaacagtatcggaaatattgaattcgtaaacaatcaggacgtgataaaatgttttgaacgcaacgtatttgttgatgttgcctttgaatctatagataaatatctgatgtatttaaactcaaaaaagctttcccctctcatcatggactttgtcaaaggattggagaatgagctggactgcacactgacaaacagaactctgacacgactgatcgtacacacggcctgtatggttgagcgcctgttatttcatgaatatagctttgaacaaaatgccggcaccagtgaatatttgaaaactcagaagaggctgcacactgctgtcagtaaaaatttacagggaattgcttcggcctgcagtattaccatcaatcaggaagaatgctattacatcatacagattttaatggaggatgatacactggctgagcatattgtattttcataatatagagatgtattcatgtgtatcaaaaaatgcgaaaaggctgattataaagcctttttcttttattggcatggaaattgctgattgattactgaaaggatgtggaattatgatgatggaatgcaacatcggtattcttcttgcaagtcatggagaatattgtcatggcgcaaagaacagtctggaaatgattattggagattgtccggatcttctttgtgtctctgtaacaccatccatgaacaatgaggatgtgcaggtgcaaatgagagaagcttatgagcttttgaaaaaggaatgcagtgaggtactgatttttacggatttgctctgcgggtcaccgaatcatgctgcagtgcgtctgatgatgtcaagggaggatataactgtagtcactggttataatctggctatattggtagaattggtaaatcgtcgcaacacatcagacctgaaggtgcaggaactgctgaacgggattgaagatacacttgcttcatccctgcgcattatgacaaaggaaggtgaatggtatcatgggaattgaattgataagaattgacgacagactgatccacggacagattgcaacaacctggatcaacaattattctatcgaacaggtattaattataaacgatcagattctgacggataagatgcagcaatctgttatttctatgaccgctccggttaatgtaaaggtgaaagtatttggtgtggatgctttccttgacatttataagaaaacatcaattcagcgcagaacaatgattatactgacaaattctattgatgcttatcgactggcgaaaggaggcgttgattttaaagtattgaatgtcggtggtatgcggtatgaaaacggccgtgtgaaaatagcgaaggcagtatctgtaactgaacgggaaagagaagcatttgaacagctgctgcatatgggaattgatgttcaagttcagatggtgcctcgggacgagcttcatgatatgaaagaaattttaacaaatacaaaataacgaaaggagaaaatgtatgttagttaaagcattgcttgtggccttctgggccggtttatgttcacttgatgatggaggtatgcagttgcagatacgtaaaccactgcttgctggaacaatcacaggactcattttgggggatcttacacaagggttaatcataggtggaacactggaactcatgtggctgggggttaattctgttggcgcgtatacacctccggatatcacaggtggagcaatcatcggtgtcaccgttggtataaccagcggaggaggggttgctgccggtgttgcatttgcagttcccgcagctactctgatcttgcagcttatcgttttactgcagacatacttatctgtacatattcatcgtgcggaggcagcggccgttgccggagattttgataaagccaaccgctggcatctatatagtggtatcctgctgttttttgcgcgtgccattccttgcttcatcgcggtatatatcggaaatacggtgttatctgatttcattgcatggcttccgaaatttatcattaccggattaaatgtagcaagtggaatcatcccggctgtcggtatcagtatgctgctgacaatgatgctgaaaaaagatatgtggatgtaccttgtgggaggatttgtttttgcagcatatctcggcctgcctgttcttggcgtatctctcatcggaatcgtttttgccggtattcatgattacaactatgtacaaagaaagaagttggaaacaagcaatacgatggaactagaaggaggtattgatttatgacggatacaaaatttgaaatgacgaataagatttacagggaaatgtttatcaatcatttaacatatcaatggggatggaattatgaacgacagcaggcggatggatgcctgttcacgctgacacctgttctaaaacgtatttacaaggatgctcctgtagaagcaaaggagcgtgctatcaagagacatcttgaatttttcaatacacatgccacgctagctcccctgcttttcggtttaatagctgcgctcgaggtaaacacgccggaggatgaaaaggattccataacatctataaagactggattgatgggccctattgccggtttaggtgatggattgttctggtttacactgtggcctatttgtgcaagtattggagcgacaatggcagtgaccggcaacattttcggagctatatttacatttgttgtctttaatatattaaatcaaggaatgaaatggttcggtttccgtatcgggtataccaaaggtatggaaattatcaattccggttcaggtgatgaagtaattaaaagaatatctggtgcagctaccgtattaggcttatgcgttgccggatgccttgtatccacgactgtaaaagtaaatgtgccactggtatttgcaagcggcgaaggaaaaattgttgtgcaggagctgatagataaaatcatgccttgttttcttccggttctggttactgttttctgttactggagacttaaaaaaacaaatggaaaggaagctgtattgctgattttcggaattatgattgtatccatcggcctaacgtatttgggaatactcggttagaatctgtaggaagcaagtgctcattacgatcatgatattgttcctttaaggctcagaaatatactaaaaagaggattcgtaaatgaaccccaagtttggactatcaaatgaaagggttcttttttttatactttacattttcaaatctcatgcttcagcggaaaatgattctctatgcagtattgatcaaaacagccttcacattacctgttcttccaatgtcaaacctcctgtaagcgatagacgcctttcgcttctatccttcaactgcctgctttgtacaaaaaggtccatcagatactgccgccacgcagcatactaatggacaccagatgatttacgtttccttacaataccatttgcaagtcaaggaatcgatcatggaaggtacgcttttccacaggtcttgaaaaataaaagccctgtatattatctgcctgaatatcccgtacaaccttcaattcctcctgctcctcaacaccctcaacacaaacccgtatgccgacactgtggcacagctgaattacagcattgataaagctttgatgaaaagaattttcatgaatcgatgatattaacagccgatcaattttaacgatatccgccggcatctgtgacagcatgcccagggaggaatagccggtaccaaaatcatcgatcgcgatgcgaatccccatttcccgcagctgctggaaggagcgcttcagcgcatccatctcggtcacaaagcagctctccgtcagctcaatgacgatatgctttgcagataaatccgcctgcttcagggtcctgcggataaagggcagaagatcctcattcagcatctgtatataggaaaagttcatgttcatcacaaaacccggattttccttcacccactccttacacgtatgaacggcctcctgaaacacccatttccctgcctgatgaatcagaccggcagattccagaatgggaataaactcatccgggcgaacatttccatattcactgctggaccagcgcagcaaagcctctgccccctccaccttcatactggaagcattgatcaggggctgatatacgaggtagaaatcctgcataccccgcaaaacactgctctgcagctgattcgcaatggataagcggcggcgtttgatctgtactagctcatgtgaaaactgtgtacactgattctttccgcggtatttactggcttccagagcattatccgcatacttgattaaatccaggaaattgtcgccatcctcccagaacatcgcaattccacctgacaccgtacagaaatagccgatatcatcaataaagtgccgtctgttgcagtatgcgtggatgattttatataactcccgcacctgcttgcgcgttgcctgttcatatacgatggcaaattcatctccgtcgaatcgatacatgcgtgccgacgcgggaagaagacgctgcatcgtctgggaaaactgccgcaggacagcatccccgaaaatatgatcgttcaattcattgatatgggaaaaatcatcaagaccaagcaggaggatcccaccgtttctcttatgctccagcagctgtgttacagaattttcacaggctgtctgggtaaacagtccggtgatggaatctatttttcccttattctccagattggatacgattccggcgaaaaaaatcggctctccacggtcattgcgttttaaaagtcctctgcagataacccagatatattcatgcttacgattgcgcacctgatattccacattatgctcatcggtttctccgttcagcatagccgtaatggaatcatcaaatcgctgtctgtcacgttcatgaaccagatccccccacaacggaatcagtccagggacaatgagatcgggaaggtcaaaatcctgcagcatattttcagaaattaaagcacgatcctcctgcatgttcacaaggtaaatataatcatccgtactattgactatggtatcatacaacatccatggatccagctgaaactcagccagaatctccttaccgcttttcatacaacaaccccgtttctgatttcaggcttctttaaaatggcagaatgcagcatcaaaatccctgtatttttgagaagctctttcttcctatatcataccacatctgcatgaaaaaaattgcatcattttcctaaatgaatggttttttagactgtatggaaacttcatcaaaaaaatatatcacaccagcatcacacatattgaaataacaaatgcttttatgtccatcttttcaagggcaccttctataacggctgcttctgtttgatattccaacagtgattcaatggtccactgccctgtcccagatcaagaccatcgcgtaatgcaccgctgataaaagccttggctctttccactgcactgatcatatcatatcccagtgccagattgccggcaatggcgctggacagcgtacagccggttccatgggtgtttggattatcgattttttcactggagagccagtgagcctcatccttatgtaccagcaaatcatcggcacggttcatggaatgcccgccctttatcagaatgtatccgtcatagtcctgcgcaatcatggcagcagccttcctcatatgctgatgattgcatatccgtataccgcttaaagcctcagcctccggaagattcggtgttatgatatcggcaagaggaagcagctttgtttgcaacagctccagcgctgtatcctccagcagacgggagccgctggtgctgaccataaccggatcaacgacaatgcgctccactgcatactgcttcagcttttccacaatgacggcaatcagctccggttgggaaaccatgccgatttttaccgcatccggacggatatccgtaaagacacagtcaaattgttcctttaaaaacttcggtgttacattcatgatcgaagtcacaccggttgtattctgtgcaaccagggctgtcaggatactcataccgtatacctcatgtgccataaaggtttttaaatcagcctgtgcaccggctccccctgtagggtcagtgccggcaattgttacaacagttttcatgttcattctcctttcaaatcatccagcgacaggaaggctgcatcggcctgcatgcagatttctttccagtgcgctttactggctgcatcatataccgctgtcacgtgaaagccatgcgtcttcaatgtctgaacggcatgcagtgcatcctctacaaacatcgtttctgccttatccgtatgcagcatggcaggcataagctcaaacagacgtccgtcctgcttatcataggggagctcctcacagcttgcgacaaagtccatatattccagcagaccgtttcgtttcaggacctcttccgcgcaaacccgttcacatgccgtcaaaacgcctatacgcatcccctgggtatgcagtctttccagacaggccctggccccctttttggcagcaacctcctgcctgtagcgtcgtcgtacgattgcataaacctctgtacgcacctgtgccagggaatcctgtatcacatacttctccttcagataccggatagcatctgtcatcgtcatcagctgcagctctttactgagattttcctctgctttgataccctttgtctgaagatagaccgctgccagatcctcccaaacccacatggagtccaccagcgtgccatccagatcaaatatgtaccccttcatatgctgcgcctccttttataatgaaaaaagggctatgccatgtatgcataacccgcgttatatctgcagtccctacgttggcattatccaaatcaggtaatcggtcgaagttcacaacttcctctcagcctgtctacaagctcccttatttccacgctcatcataccatttccatatattttcgtcaacaggcatccgcgtttgaagacaaggttttttctaaacgcaggctgacagatgaggattctgcaaggccggtaagaagggaagcagacacacccgatgccatcggatggtatccagctgcacatttgtcccttccatctttttatcgggaacagttacgtttcttcttcagctgtgatacaatacattacagaggtgataacatggatttagaagcattttttcatgagtataaagaaaaaaagaacgcctatcagatggcactgagcacaatgtattatgaccaggccacgattgctccgaagaacggcattccctaccgcaaccgcatgacggcgatcctgtcgggagaagccttcgatcaaatggcggacaagaaaagtatccaaaggatcgaagagctggcaaggcaggagaatgtaagtgcagagcgtaagaaagagctgcagctgctgttgcgcgagctgaatgagctgcgtgtactgccaagagaggtgtacgtggagtatcgcagaaccatcgcagacagtgaggccgcatggcatgaggcaaaggaacaggatgattatcagctgtttaagccgcatctgatcagcgtcatagaaaagcagaaggagattctgtcctatgtcacagataagaaaagcgattatgattttatgctggacagctatcagatcaacaccgatattgcatattatgaccgcttcttcgatgccattcgaaaggaactgcttccgtttctgcaaaagctcctgaaggagggaacaccgattgacgattccctgctgtttacagcctttgatatcaaggaacaggaggcctttatgcaggagctcatggactatatgaaggttaatgacagggaatgctatatgacaacaacggagcatccgttcacggacttcttctcagcgcatgaggcacgcattaccacgcattatcatgaacacaatgtgatgtctgcgattttctcaaccattcacgaatacgggcatgcacaatacggcctgcaggtaaaggaagcatatgagggaacctccctgttcagcggaattggtacagccatgcatgaatcacagtcacgttttatggaaaatcacatcggaagaaaccgtgcattctgggaagtgaattatccaaagctccaacagcattttccaaagcagctacaggatgtttctccggatgatttcatgcggatgatcaatgtatcacgaccttcctttattcgtacggaagcggatgagctgacctacccgatccatattctgatccgctatgagctggagaaggaaatcttcaacggcactgcagattatgacaatctggatacgatgtggaacgataaatatgaggaatatctgggaatccgtccagagcatgaccgggacggtattttacaggatatgcactggggcggtgctctgctgggctatttccctacttatgcgctgggaagcgcatttgcggctcagttctatcatcagatggaacaggatatggatgttgaggaagcactgcgcagcggtgcctttgaaaaaatcagcggctggctgaaggagaatattcatcagtacggtgccttcaaggatgcggatgagctgatgatggatgtatgcggggagtcctttgatccgaagtattacatcgaatatctcaagaacaaatacgcgcaattgtatcagatatctgccgattaaacggagatattgaataaaataaaaatataaaaaaagcgaaaggctgcgagaaatgcggttcttactcgattgtggttatattcaaaaaaggagaattcaatactattgtaatttcaatagaatttgaattcttcctttttcaaataccctaacgtaagaaagaactagaaatgctaatgctatcgttttttattttatcatcatatttctgcttttttcggtatgttcattctgaaataaacatacgaatttaagtatttgtggattgttttctattatatattatcttacagaagatcacacctatgaatcacctgtctgtccttcctcacagcctgcatacaacgcaactagatccatacatcttctttttttcttacaggctgatcattcctcttcagctttccgataatcttcaatcagctttttgaaccagtaatagctttttttcggatatcgcctgttgtgatcatcaaaatccacccgtacaagcccgtaacgcttttcataaccgttaacccagctgtataaatccatcgtagaccaggcatagtacccccttacattgcagccgtcttccatcgctttcaacatatagtcaatatatccctgcatcatttcgatacgctcatcatcctccacatagccttcatcgtttggtttttcataacagccatgaccattctctgtgatatacacaggaatatccccatagcgttctttaatttccatcaatgtgttatacatgcacttcggatagatttcccttccccatagattccgttttgtatttggatcgatcgctgtttcataccagtccctgatacggattccctcttttgcattggagcctgcccccttattgttatggaagacctccgtttcccctgctgagtagtccgtaatataaaagcgattgtatacgttcaacccaaggaaatccactttcccctgtaggaataccagcatatcctcaaacttaatatagctggtatcgattccatacttccgcaacaaaggaatcagtgcgcccggaaattctcccttgcatgcggtgtctaatatgatacggttataaaacagatccgcaatcatatgaacacgttctttttccttcgtatccggtgctacctccacattactggaatcatgcacaataccgattgacccgttcagcttcagcgaatggtagattgccactgctttcgcactggcgactgcttcatgatagaccgtcgtaaaatagcggttaaaatcatgacggtgattgggaggataattccctaccatatgactgcaatatgcatagtatttcggttcattgatcgtgacccacagctttacacggtcaccaaaggcggtaaagcagacccttgcatattctgcaaacgcatctacgatggcacgattttcccagccgccttcctttgcaattgcttccggtaaatcataatgaaacaaggtcacattcggctccacaccctgtttcagacagtagtcaataaccctgttatagaaatctatccccccctgatttacagcacctcttccattcggaaggattcttgcccaggagatggaaaaccggtatgtattctgtcctcctgccttcagcatatcaatatcttccttatagtgatggtaaaaatcacaggatacatcccctgtagcaccattgatattcaacgggttaccatgggaaaatacatcccattcccctaagccttttccatccgcatcccatgctccctcacattgatacgctgctgtggcactgccccataaaaatttttgtttttctatattttgcatagtagcctccatttctgcatctaagatgcatcattttacttgtttatgtcacgttttcttgatattggtatttcctatttactttttgatgatataccatgttttcgctgtgaaaggaaacgtatatttcattgatttccccaacaggagcatacatacccatgttccttctctaactgtcgtgaaatccagatgggagcatagaatcataaacagactcagcagcatgaaaacaatgtctattctggttcgaaatatacaaaattccatccgcagccgtttggatatgaccatagccagttcctcaaatggatttttaacaagatcagcatgaaataatacagccacaccataggaacagaagagtatacctgaaaagatacacagccattttccgatataggtttgcggataccagtcacagagtccgggcacatcataacagatcagattcacaatttttccctgcagcagtgccagaggtatttgaaggtactgtatgtttgcaaactgctttttcaggataacgatctgtgctcctgtgcaggatatgaagaatataatcagtactgttccactcttgataccggtaatggcagttagattctgtgtaaaagctgttattgcagtctgtcccaactgtgatttcatcatgcaggataacccgattgctgttatcagaatacccagcagcatttcaataagacgcaaatacagatagggttgtttttctgctctctttttcattccgcatacatttccataaaacgtgcccaaccgtcctcatcacatggatagtctgtgatgatatctgctatcgcctttgtatcatcgctgccgtttttcaaacacacacctacaccacttggttccagcattgtatgatcatttgtcgtatctccaaacgccataacttcagctgtagatatctgatgtttttcacagaattttttcaaagcgtatgctttggaaactctgcgatgagaaaattccataagggtggactgtgttttaaaaaagtgataatccttagaaggatgagcagtaagatatgcttcaatttgcagcatatcttcctcgtttacccggaacatgattttggcattttcttcctgataaaacaccttcatatccgtaacttccattgcttccatttctgctgatgtagccgattgtttcacaacctcatccatctctttgcaatatatacaatcatttcgatagataacgggattacaagtgaaaacggacattttttctatgatttcccgaatccattcctttttcagtttatagtatgtttcttcctctttcgtaagattgtcccaaagcgttgatccattcatacatatcagcatatcaacatcttccaatccccagcggtgcagcaatcttcgcacttctgcaagagagcgtccggatgccaaaccaaatacgatgtgtcgtttacgtagttttctgataacttcttttgctttttttgttaacgcatgatgttttacaacaagggtattatcaatatcacataccaccatccgcagcttttccggtttcatgatcttcctttcgatgtaagaagatgttcttcatacactggcaagcgccatctctttcttcaacagatacggtctgagatatgccgttgccatgcttgttggtaacacatcctcctgaatacggattcccagcacttcctgcatatatgctctgcgcttcacgatgcgttcccacacagccggatattcctttgcgattgcctttcgcaactgctcatctgctagtaaaataccactttcacagctgactcccccataaccgtttacacttggaatgatatcaatctgaaacagcatgccgctttgtaatgtttcctcagactgcggatagatcggtgaggacatccattcctcatcagcgcacaggtgccccggattcagtgtccagccatagtcctccttcggcaataccgcctcaactgcctcatacaaatcgtttccgtttatcccgattttaatggtttccagccaggtttttactgcctgaaaataaggaatcgcgactgcctttagataatcctgttccttctcaggcagctgctcagcacattccactgcatagcctgcacgactctgcaatcctcccttaaatcctgtggtgatggaaattttatcaccgcactgaatttgtttattacccggatacagattggctttttcaaaacgggctcctgtagccatgatggtcacaacactgtgacgctgtccgtcagctgcaagtgtttctgccatttccatttccgttttaccgacctttaggcgatccatggtcttcagtatgcagtttcctgccaatgctgccccgtattcatagtgtgcaaactcattcgcattgttggttgtccgaacaccgttttctccaatgaggagatacgctgcattggcaaactgtgcttttccgcaaaccgtcttgagtgcctcaacaagaaaatacggcaaatcaaacagcagatgattatcctccacatggctggtaaaattcttccatccgatcaatccgatttttcctgcatcttccaactcgcaggatgccagtatttgcgcaacacttttctctgtctgcatcggctgattcggcagggagaaatgcggcatatgaataggtactgcttcaattctggcttttcccgccttgtttaaattttcatttcccagtaccataaatgccttaccatttgcatgaagaataagcaatgcttcctcaaagcgcggtagaaaaccgcacagatattcaaaattactgccatgctccagatctgcatatacgactactgcatcaaagccgtccttctgcatgttttcaagcagacgtgctttccgattctgcattgtttcatcgctcagcatgacagggataagcccctcctccggtttcggtgcctctacttcttttaacttaatcatacattccttcctttctcataccgtatttccagtttatcatttccgttgaccgttcctacatatcatccagcggatacatcggacgcataatcagcttgaacggtatccgctttgtatcctgcaaggttgccccatccgttaaggacatgatgcacagctttcctttttccttcatttccggatggatgtatccctgcttaacaacgatgacatcataatcatcccagtcgataccgcatgcgtcaatctggtgcttttccacaaaggaatgattattatccgtaacaacgatcgttatcggcttatcctttaccgatacgctaaccagacctccgtaatctccttcttccccatacatatgcgttccttcctgccgtccctttgcaagtattgttacatccagctccaccgcagctgtacactcatccatatccataccgaggcgtaaatgaacctgctcctgcacatcatgtgtttccagcagctgataggctgcgggatcattgatcgcggcaaacaaaaagcgttttgtcagatgttcacaagctaacacctgccgtaatataaatgtgttagcccccatcgccccggaggtcacattatccccggaatccgtgagaaacaccggctttcctgaaaaatcaagagctgcctgcaatgcttcctgcggttctctggtaagacccgtgtaatgaaattcatggcgcttaccccagacatagttcatcagctgatctgctgtttcttcagcatattgctgaaagtcctgtgcgcttggcactacgacaatcccacagcctgcttccggggcatcatgacgcagatatccgacatgccacgaacagctcagtatccgctcatccttttccagttcattcataaactgattgatggaacgtaccggttcatccgcagaaacactctgttctcctcccagtatcaatggaagctttcggtatacaggacgcatattcatccgattgcggatttcctgaacgagtgcacggcatacaaattgtacagtttccggaatatcagtatgcggtgcctcccgaaagctgcgaagaatggtggcattctccacatattcctttgtcagatttccatgcggatcacaggatatcgctatgggcagataggggccggtaatcctgcgaatacagcgcagcaagtgatgctcccccgaaccgatatcctctacaaagcttgcgccgtgcaggtgaagatagataccgtccaaatcctttacatgttccttcacagcctgtagaatgcgctgctcaatatacataaaacaggatgttttcatcactccgctgcatccggcatccgcacagattaccgggatgagatctatatcctctgcatcaaacacattgccaagctgcatgtgtgacagtgcttcctttccataagacaacgccacattctccatatcacatttcatcggtacatgggcatttgcctccaatacaaatttagctgctaaaattttcatctgcttcctcctcctgtcatataatccgtatatacgtttggtatgcttcagatatcatcgattggaaacatagggcgcatgatacgtttaaatggcagacgtgcagtatcctgaagagttgccccttcggtcagtgacatgacacaaagcttcccctttgctttgaaatcgggaaaaatatacccctgctttacgacgataacatcatacgcatcgacatcaatgcctgcactgacaaactgatgcagctcacaaactgcccaaccggtatccgcaaccatgatatcgatcgaagttccctttatatgaacattgacacagtgtccgaaaacagaggtatgatcatgcatcataaagcctgtcaggtttccactgcttttcacaacagcatccagctccaccgcactgctcagctcatcaaagcctacacccagagtaaaggaaagctcctcccctgttttacatgcggacagtgtctggtatgcggcaggatcgcatatggtcgcaaataaaaatttttttgtcgtttccgtttgcagcacctgacgcagtataccggtgttccatccggttgcacccgatgttacattatcaccggaatccgtgataaacaccggcttatcctgaaaatccagtgccatctgcaacgctttggaaggcgaagctgttaagcctgtataatgaaactcatgacgcttttcccatacataggcagccagacgatccgcagcctcctgtgcataaggcaaatcctgctcactgtatggaacaacaatgataccgcagcctgcgacatcacaatcatgacggatatagccaacatgccaggaacagcttaagatacgatcgtccttctccagttcatccatataccggttgattgataagaccggctcatccgcagatacgctttgttctccacccagaatcaaaggaagcttgtggtataccgcatgaatattacgccgttttttcaacagctcacacagcatttccgctaccttttccattgtttcatcagcatccgtatgcggggactcgcgatagcttcgcaggatggttgccgattctgcatattccttgcataaatttccatgcggatcacatacaatcgcaatcggtaaatacggaccggcaagtttacgcagctcctttaaaatatgatgatctccggacccaagctcctccacctcactggcaccatgcagcatcaggaaaataccgtcaatttcatgcaaattcttttttagcgtatcgataaacatatgctcgatatacgtaaatgcgcttttctctacaacaccggcagctccggcatttgcatatatactgggaatcagcgtaacatcgttcctttcaaaaacttcacggattcccattttctgaatacaatcctcaccgagtccgatatcatactgctttatcgtacatatagtgggaatattagcatttgattctgtgacaaactctccgacgagtaccttcattttcttacctccgtgttcttcgttcctttatttgtttcatttgaaagaaagacttcaacaaatacagtttcgtcaaagtcttttcttactctattctttcacagtatctgtttttttaagaatgtagctggtcgccacaaaggatacgacaatcgcaacaaccgctactgcaaaatataggatgatattccccgtagaaccatctgcgggcaggaaatagaagaaggataacagacccggacatccgccgacaacatagttttgaagaccgaagattccggcaatcagaccggagcataccgcaccgattgcagtaccgatcagacatttcggacgcatgatcagggagccgtagaaggcaggctctgtaacaccgcacagcgctgtaataccaaaggatgaaatcataccctttttcgctttatcttttaaatggaacgcaactgcaagtgcactgccgccaatacatagattggatacaagacccataaccatattgaatggatcatagccgatttccgcaatggactgtgccataatcggcgtaaatgctttatccagcccaagcataaccatatacggatacagggcagacagaataggcattgcaatccagccggcaacactcatgactgcctgaattgcggcaccgacactgttgcttagcatggtaccgatcggtcctaaaacaatcagagtgataggaacaacgatgatcatggttagaattggttttaagaaatacacaaacatttccggaatgacgcgtttcaggaatttatcaacgaaatacataacagccacacccagaatgatcgggaacacactgcctgcataggttacggttggcacactgagtcctaggaaatcaagccccttcgcatcactgcatacaaacagtacagctcctaaaaaaccacccataatcggttccatacgcaatgatttcgcgaaggagtatccgatccagatcgggaagaatgagaagccagccgtgaagatattcagaagcagtgtcgcagttccgccatccgcactcataccgaagtagtttaccagcaggtttttaacagccaggatcaaacctccggtaatcatagccggaatgatcggcataaagattgccgcacatttgtttccgaagacattcaaataatacatgaagttcttttcctgctcatcatcggacgaatcattccccacggacggttgttcatccgttaccttgaagccggaaacatccagaaattcattatacgcatcattgacctccggaccgataataatctgtacctgtccggctttctcaacaagtccaacaacacggtccaccgttttcagggcctccacatttaccttgtttttgctcttatagtgaattctcaatctcgtcgcacagtgctcaacaaatgtgatattttcaattccgccaacatttgtcaagactcctttggccatttctgtatactttgccataaaaatttcctcctttaatgaaaataaattttctaagaggtttggccggatctaccgtcaccatccaatgctgtgtgtctttcacctagtatagagatggtatcgcttggcttacttctctatatccctttctcactgattttatatcagaacctgaaggctacatacaagccgctgaaagtaccgttcatccccaggctttccggaatatcatacgggtacatatcacatatagctatctcttttgaaaccagtgaaacaagagtaagccggcaatgctgtaccggtattccaaaagctctctgcaggcttttttgtatgttattcaggattctttttctaaacgctgtccttcgttaatttattcaaatgaatcagaagatataatttttcctcatcattgacagagtatgcatactttttttccagcatctctgcgatttgatttacacaggcatactgctgcacactctgttccttcatcatctgaaagattgcctgatttgccgttgattggtgcacaccggcttccgcattgacaatgcgctgcacaaagaagcggcaatggatgaggaaccggtcaaaatcataattatcctgtacatcgacttggaagctctgcaacacaattgtattgatgctttccaggatggatgtaatggtatatatttccatcatattggaggtaagctcggcgttgacgatatgcagcgttataaaatttgcttcgttgtcatcgatatgaagatgaaatgcattgcgcagcatttcgattgcatgtaaagcgagcttatattcctctctgtacaaagacttcacatttaacagcatcgtcatgtcgaaatctattcccattcgtatgcgctctatggtgttcgctatatgatcggtgagtgttacataaataccgtcattcagtgctttcgtgctgtgttccttgaaatacgcaatgatttcctcagataccagaatatagtcgattggtgtatcctgaatcattttttcaaatttatgcttcgcctcccccttcagctcgaacttcttttccgctttttccgcctgaatttcatccccttttttcaaaccgaatacaatgccctttcccaccagaatgacctcatccccagcctcgtttttgaccatggcgatgttattgttataaattttcttgatctgcatatgagtacccgcttacactatctcaaacaaaggctcccccactctgatatccccatttgttttcatttgatcaacccttttatttgttacaataatcggcacaataacatccatgtttttatttcttatcatatcccagtctacgatggtcagcaaatctccctgcttaacccgatctccaacctttgcttttgtttgaaacggtaccccgtgcagctgcacggtgtcgataccgatatgtatcagaatatcggttcccaaatctgtctgaataccgattgcatgctgtgtttcataaatcatggttaccgttccctccacaggactcctcaattcattctcatccggtatcactgcgataccgtctcccagcattttttccgagaacatctcatcatgtacattctccagcatagtagctttgccattcaccggactacataaaacttccattttctttccctcctgttttccttgttcaattcacagcctcaccttttttatgtatgaagctctgtgctttaacagtatccgtttctgcacatcccgctcatttcgcttatgtttataagacacaaaaaagcaagacgttatcataccaaaaatttggatttactgataggtcttgcttcctaaaatcaagttaagaattacaatccagtcatttctttatccgcacctacagtatagcaccacgctgaaagcgttgtcaataccatttttttgtatatttttaacatttttttatgattgattacgattcagcggagaataaatcaatcaaggctactacaaaggggactcttaatctatgagattactgccatacgatattattttgtccttatccaagctggattctactagatatatggatgaattacagcttcttacttttaccgcttttacattagcaagaagccggcagaatgtctaactgttccttcagaaatgaagattacagcctgtgttcagcctgagatatgaaagcgttcatccccctaatctcaatttctttcttattggagaaagttgaaaagcatctttcaaaaacagttccttgcgtaaagaagaatccatgggtataggaagcatccttcctacatacaatattccatgcgatatacgaatgaacatgggaggctgcttatgaaatcatcacttgaacaggaattcgcactgcatctgccaaagggaaacaagccctggtttgagggctggtatgtacgtgttcaaaccaaagaaatcagctttgcaatcatcttcggattacagatcagcaatgctaagaaaagcgcatttattcagtttcttgacacgcatacgaagaaaagccgctatgtggaatatccatggaaggctgtaaccatacagcagcatccgtttgtgcttaacatcagaggaaaccggctgtctatgaattccgtaacactgcgcctgccgcagctgcaggcggatctgctgcacagctccttaacaccgctgcatacttccccgtatgcaccgaccattatgggtccgttttcctacgtgcctatggaatgtgtgcattccatcatttctctgcgtcacaccgtcagcggaacaatccgactgaacaatcgctgctttcagattcatggtagcggctatatggagaaggaccgcggtacctcgtttccctccgcttatgcctggtttcagtcaaacaactgtgaggacactgcttcctgctttttcttttctctggcacatattccatttctcaccggctcctttcagggctgtatctgcgtgttgatggttcatgaaaaacagctgtgctttgcgacctatctggggtgtcgtgccacagaggacaggaaaaaccagcaaatcgtgctgaagcaatatcctctggagctgcgtatacgcttgtctggtgaaaaggggcacacgcttgcttcaccgaaacagggagccatgcagggaaggatacaggaaaccctgaggggtgaggctttcgtgacacttctgagcaagggcagacatatcaaaagctggcactttacacagggaggactggaacgtgcaggtattgacatctaatgatattatgagagaatgaacgccttggttctgcctgcattatacgtaaaaaagcggcattcgtcaggacatttccatggaaaaagctgcggttgagagcataaccgcagctttttctcatatgcgcagtgtttccagcttgcgcaccagacgtgtattttcctcttcctccatgctgcacataccaatgtgaactacaggcttcgtcttcccgtggaagtcacttccgcaggtcatatacaagccgtggctctttgccagatcataataaaactgtgtctgctgttcactatgataggagctgaacacctcaaacccatcaacaccgagctgaagcagatcatgtatgcgatccatctgttctttggcattcatcccgggatgtgccacaatggccaatgcattttgctggtgaagcagctccacgatggcgctgacactcggatagaagatttccacataggtcggtttcccaggtgcgcatatatcccagtaaaaattcacaaaaggattatcgctgcgttccccccctggataatacggctgcagaagcgggtttttcttttccacatcatactccatagcagcctctccaatcgcctcaccggtcgtgataccgccggggcttaattcctgaatacgcttttcatcaaaggcaatccccatgtcccgtaccagctggcggcggcgcttgcttgcctcgcgttcctgagaagccacatgctcctcaatttcatcaaatacaggattatgaacatcaattccatatcctaaaatatgatagccgacatcctgtgacacggcatctatttcaattgcaggtatacaggtgattccatattcctgctgatggcgaagtgcaatccggcttcctcttacactgttatgatcggcaatggccatcatatccagaccggcagctttgcacattttcaataattctatgggttcatactgcccatcgtcgctatatttggaatgcatatgcagatccagttttttcataatgaagtacctctttctttccgtatgatctgatcaaaaagctctcttgcggctatttctctgacgcccagtgagaaatcctcgtggatactgctacgtaagatcatcgttggaggcgtcagcaccttccactccgtcttcatgatagtaatcagcttcttcagcagtgcctcatccattgtgtcacaataaatcagaagcgcatgcggatcatacatacaggcgatgctttgtataagcaaatccatgttacgcagctgctgttcatcactgatattctgttctctccaatcaacgcccagtggcagctgatcaagctctcctaccatgtgattcgcgccgcgataaatatctccgcggatatagagtgctgaacccggcggatacttttttggaaaatacagacccgctgtacattcctgacgtatagtctgccgctgacagtaaccgaataaagccgcattgatatcattttctataagcacaggcatctgataggtgctgcgcagtcttgcgaacagctcctgtgattggaagattgcataatccataaccttcagctttccctgatgctccgtaccgggaataccgaagaccataactgaaattgtcggatactgtttcatccacctcgaaatggcatgctccagcatatcaatatccatatccgctatctcataggcatcggatgctaccatgttttgaaataagtcctgaacctccagaaataaccgctctcttccctcttgaacatacatatacgctgttaatgccattttataacggccattgtactgatactgcagggcaggtcgtcctccaccggatggaagcatctgcttttgtattacttcgccggtttccaaaagctcatggattaaagaattaacagtcacaacgcttaaaccactcagctttgccagctgtggctttgtcgcactgtgctgcttgagaaatacgtttcgtaaaacagatagattctcctgtttcatctgtatgggattccaagccaataaatcaccacctctttttaaagattctttattaagtcacctatatcgtacaggaagctgcataaaatgtcaactgcctgctgtgtaaaatatggaatttaaccatcatacgatagctagaaattcactttgaatatgaagattcataattgaaaatacaaaggctctttgcgtttgatataaattcgtgtctgaccttgcaaaagcatgagaaaatatgcgaagtgaaaagatgaaatccgcagactatgaaactgctgaagcaggtatcgcctgtcctatggtatctgtacaatagtttaaatccgcggcactcgtttagctctacagataaaaagaagtttctttgtggattgtgattatttcataaacacaatcgtctcgaaacttcttttcattatcttattctctgctcatggaaacacgttttccacaatgtgccaaggcgatataaacacagttctccaaaccgataccatattttttctttttcatctgttccatacccgctgcagctaatgcttccagattcacattctcatccttcgtgtatttcaattcaaacagcatagatggcagagcattgtttttactgttgagcaaaatatcaaaacgtccttcgccgctttccctgttactgacgatttcataatcgtttcgcagccacatacacatacctaaaagcagtgagtggtatgaattctcatttcttaaatcataatagctgacagactccagcagcattttctgataattcttcaaaaattcatcccagttctgtgtttttagtgcctgaaacatttttgccaccgtggtttcatccacattcagaaaaaacaccgtcagtgattgaaatcctcttgcgacctcattattgggaatccgtaaggagtacatgtcctcaagtacatccaaagtcttatgtacagttaagtatcccgcattgacaaatagtccccacaagctggatgtatttttcaattcataaaaggaggtttcaaaattcaccaatgtttctactgtaccggttttgataagtttctcataatcatccttaaaatcctgttcacagctttgcattgcttctttgatcattgtattggaactggtattgatccagtagggagccaataccttcttgcatacatagttcacaattgaccatggattatagatgtcgatgcctcctatgttatatccgtcatacatgtcctttacatcagctgtatactccatcccgttatcaacaagcatcttcttaacttcattctctgtaaatccaaaatagcttgcataatcagcatccttcactgtgcatacaaatatattattcaaatcactaaaaacgttctccttcgcaacacgctgtatcccggtaatcatagcatattccaaatcatcgctggatttcagtgaggtatgaagcaaagcagcaaacgccccgcgtacatcttcataaaaacctcccgtatgagcttctataaaaggcgtgtcacgccttgggcgggcagcgcctattcgtctataaaaagcatgacccgctttccatagtattgatgacaccttgtcataagaaaactgatggcgcgatcaacggtctccagatttccatcatccaaatttgacagtcccttcaaaatagaatcaaattggggcttttcaaagatgctcaaattttccaatgtaaaggagtattgatcatataccttaagcagttgttctttcacgcatgcaacaatccggtttttactatcctttgcatctgcaaatgaaagaaatattgtcgggtagctgttcatatgttctgcgtactttgttttcataatggcagtatctgcaaaaattacttttgaattctttgtgatatcgaagaattctgcaagcacgccatgggcgggcagcgcctgctcatattgagtgttttaccgaatcggcggggccgtgtaaccaacgtggcttttgccatccgctcaagaaattcctgaatcagaagacttttatcaactacataataatttttttctttcaattctctgtaattcatgattcctaacggaattccttttttcattatatcactcactttctcttcctattatatcgcatttctaagtttatagaaaccagcgaatgaagaaatatagaattctgatttacaatgcaagatttatcatgataggttgttctttgttccctatgagaatccatgcacgctgctttcatagcaagacgaaaagcagccggttccttatggttctttcttgattgcaggtaaacttgaaacagggagacatccatacgattatagttatcaatagaagttgaagtctcccttttgcaaacaccctaaagcaagaaagaacctcccttataaatggctgcttttccttcgcattttaattattatcagctacaattttctgtcctgaatttacatggcattttatattatatgtttttacatttaaacctatggatgcaacaggttttttatgaatcgtgtaacaggtgtatcctctgcatttctgaaaaactgctcctgaaattgtggataatccagaagctgcttcagcaattcctgatctgttcgctgtaatgcttccagcaatgcatactgggcaggcagctttgtttcattcatcatacgtgctctgctacgtttttcaccttctgcatagcattgcggatagccaccaccgaattcctgtgcaaataatttttcgaacacatacttcagattgatttcagcaccccatccaaaatactgggagaatggcaaagataccgcatttcccgcattcacctgggtaaacaaataagcatcaagtggtgtattgacatagccgcaaacaacatcagcgaacgcattacaggaaatcatagctccttgccctgttccgcagcccgtcacgacaaaatctactgcgtggctgtgcaatagaaccgctgcaagaatacctatctgcgtaaaattaatctgatgactatcctgttccgtatacataccgtaattgaataccgtatgtccttttttctctgcttcctgcttcagaatatcaaatatcatggcattcttatctgcctgtgaatcttcatttatcaatcctattttcatacaacctcctaaaacatcgaaatggcggcaccaaggataccaaacaggatgataccagccagaatataggttaccttaatatcctttttcaggaaatagaagatcagtccggtaaagcatagtggtagaagattaggcataacgccgttaatggtgtccagaattttcacatcgtcgtaagctaccgtcaggggaacactgacattggttgcgaccattccgcctataaccatcaatcccagaataccggctcccttgaaaatcttatccatgatgccggattcctctaccttattcagaaagctggttcccagctcataccccttgtacatcagaaaataacgagatgcaaaatttggaatattgaagataagcagatagatgatgggtcccaagatattgcccttcaatgccagagaacagcccagacttgcggctattacacgcagtgttccaagaaagattgagtcaccgattgccgaaagcggccccatcattcctaccttaacagcattgatggattcagtatcaaagtccctatcattcgcattctgttcttccatcgccgcagttataccaaatagtactgtacagataaatggggtaatattgttaaactccaaatgacgggccaatgctgctttcatttgttcctcatcatctttatatagcttgcgcaataccggcataagggagaatgcccatcccagatttaactgcctttcgtaattaaacgatgaattatacgctatcgaacgaacaaacacctgctttaaatctttttttgtcagcttcttctctacagaattagaattcattatcatccatacctcccatctccacattgtttttcttacgatcattcataataaccagcagagcaattaaaatcgcgatgcatgcaattccaagcacaggaatctgcagatagctggcaatcagaaagccgataaagaaatatggagccagctccttactgataatcattttcaccagcatggcaaagccaagggcaggcagcatgccacttgcagctgacaatcccttcataatgaatgccggtatctgatcaagcactgcctgaactgcaggacctccgacatagaaacaaattccgactacaattgccatcggcacacagtatgccaaagttgaccatacatgcatggcagctaccttggagtcattcccctgtaatgcatagctgtctgcacggtgtacaaagaatcctcttacaaacgtataaataacctgttttatcagcaaggcgaaggttgcaatcggaagggaaagggcaactgccccctcgataccggagcctgtggttattgcaaatgccgtacccaggattccaccggtgtaaatatcgggtggaaatgctccaccgattgtcaatgtccccatgtagaccaattccagactggcccccaccattagtccctgctgtacatcattcaatgcgataccaaccagtacgccggtacaaagcggacggtcatattgtgaatatcctagagcatctcccatataggcaagaaaagctatcagtgctatcaatgctgcttgtatcatacttcattcctctctttcatttaaagtcgcttaacgggatcactgggaaccatacgaagctctacatcaatattcttatcgaccagctcccgaagcatcatttcctcttcatctgtaaaattgatattatgattggagggatgcggatgtgtatgctctcctgctttcagacctccaatgttgacgatatggatacggtccacctcactggcaagacgataggcatccgttacattatccacaacaataaacagattgtatttatctgctttcccgctgtttaatgccgcgatggattcctcgatgccttttacaatcagcttacagctggatggcttggcgaggcgaagcgttgttctgcgcagatcattggttacacaatcatcattcgcaatcaatatgcagttgaccccgagatacccggtccaggaaaaggctacctgtccatgcagaagtctgtgatcaacacgaagcattttaatcatatgttcatcctcctaaaaatcgttttcttcctgcaggtgtaaagtgtctccactgcagaatactatataatcactgttatgctctacgattttctgaatcgtatctgattttaattcgtccggatacagtgctaattccagcagcagactgagatttaatccggaaaccagataaaacggataatcctctgtaaaacgcatgaattcgttattcacactacctcccaacaagtctgtgataaccagaagcgcctgcttttcataatcatgatcagctaccagctgtcgtatgcgtgcgctgtagtcaacgctacgatcaatataagcacaaagcggttctacatggtcctgctctcccgcaatcattttaagactatccataataccttctgcaaatcttccatgacttgcgataataatttttgttttcatttagaaatccccctcttgcgttccatgcagtttgtcttctttgatataatcatataaataggatatttcgctcatagatagctctacgccataatggctgcatacctttgtgaagcttcttcttactatctctatgaactttctgttttctttctcaaattgctgcaaaccctcgtgattggtaatgggttcttttgttaccagacgttcaatcatacagcatagatgaatatacaatccagctagcgtatttccatagaagcggcggtccaattgcagctgcatttgattgacagcaccctctacaaactccagcagcttttttgcatccagaatagataaggtatccaatgcattgccaagtgagaaattatggattagatttctcgtaaatgtatctatatcttcaatcgtcaaatatttattaagcaaggttctcagataatccagctgattagaggtaatcaaatcctccagtgatataaactgcttcggacaatcaatgctggaacagataccggatacaaatagaatattatattcctttgcaatttcattcatatagtcttcatttctgaaatccaatagatcgatagaaagcatttcgatatcgatggccttcggcaatgaatccgcaaataattcccgcatgcgattcgccattttgattccattgtccgatatgaaaattatcaaatcttttttctgcttgttttctacaagtgtataggtacttgtagaatgctctgccgctttccttaataacgattccatatccgctccctgcagtatagattctccgatatccagagcaagtcttgtcgatacattgttgatgatgccgatgttcttattgtctatcatagtcagctgttcatcaatatgctccagtgatcccatgtccacaagcaaaaggatatcattttttattgtatagcgatcaatatagcgtttcaggcggtccgcaatatccggcatggaggtatccagaggcatatcaaaggcttcgaacagatagctgcccagcagagaatttatggcctcggccatgctgctggctgtggaatagccatgtgcgataataatggacaaatatttattctgatgggcatgctcatgataaaagccgagatgaatcatgagaattactttttccatatcatcaaaccctaattccagatttgcaagcagggcatagctcagcttctcacagatcagatacccctggggatactgcttttccaacaggctcagacatttgctgatttcataggcatgctcctgtttccattcctcaagtatcctgttatgggactgcctgccataaatacaagccgcaaacagcgggctgcagtgatatggaattgaaacgttgtatgttgtaagaacgcggttcaaaatattacgaatcgtatgctctaacgcaaggatctgctgatttgtatatttctcgttatatgctattgcactgcaatattgagtcaatacaccattcagctcctttacatacgaaatcatagaagtcgattcatcctttgggacacgatttaatatagtttcaaacagctccagcagctttcttgattcttcatttcgtttaaaggaggaaatatccacatactccacctgttcctccatataatcctgttcacccaaatccattaaaatggaatccggaagctgatacatacgaatatacagctgatcagtcgtttcctcctcactgtttgcacgtgcacatacatcttctaccgtacgttttaattcatcaatattgcgtttataggttctagtcagtagtatatgaatgaggtttttactaacaagcaaatatctccccagcttccatgactgttgcttaaagaaatgtataatcagctcttccttatcatcctgatagcgctcatccaaatttggcatccggcaaatgattggaaagcattgaatcaggtcataatccagatatttctgataatcctcatccagtgaaagtatgattcttgtacgaagcgtgattcgtattcctccacgaataaagcctccatcctccaaaatacgcatgaggagctgctgatcatgcttgctcagattctgtgcctgtgtaagatagagaataccaccttcgcattgctccagtaacccttttttgacttctgttcccaacagctgttcggccaactgcatatcctgttcaaggaccttatatttctgcagcagagcctgttcgggaataatacctgcatcctgtccatactcaaacattttttgacacataagcgacttcccactgcctttttctccataaagaatcacaggaagaccatttggaggatactttaatgcggatttcaattgatcaatcacagtatgaagagaagtgtcatacccgatcattttcataaaattgcgcttaatacatgtttttttagacaacgtatccagaaaatcctcaacgctgtaaaacatactctctttaaactgtacctgaaattgttcctcaatgttttttctggaaaggaaatacacaggtcgtgtagcgatttttataagaagaccttcctttacgaagccatttagatactggcttgccagagatcggctgatatggagttcactgctcagaatatgagcagaaaattcctcgatatttcttaagtccggttccaccttctttgaaagaagatgatccagaatttcattttttgtgctgattgtcatttgcattactcccttcaatatctgatactgttatctagattataaaagagataaaagcagtgcacaacattgttgaaaatttaaacactaaagtctgatcttttctttgtacgaacactttttttcacttctcagctgccatatttttccaaaccatccagagccttgtttacgatatccgcactggtaaggtggaatttctccttcagatattcttttgttcctacttcaccgaattggtcatcaacagaaatatgacgaagcagcgcagatgttttctgctgtgccataatatctgctaacagctccccaatacctccatatcggctatggttctcgattgtgacaataaccttatgcgtctgtatcacattttgaagaactgtctcatctaccggctttataaagaacagatcaatcacacttgttgatatcccctgttcctccaactgctttgcactttctaatgcatcatagacaccggcaccgatagcgatgagtgcaacatctgtacctgtttttaagatattagcctttccgaatgtaaaggcagagtcctttgtatatatggacggcaccggttttcttgtacagcggttataaataattccgccatgctgctcataccatttcagaacccaggagaatgccacactgtctgccggtgctacaacatgaactgacgggattgcacgcataatagcaatatcctcaaaggtggtatgtgttgccccattgtacaacgaccagtaacctggatctgatgcataaatatgaagatcctgcttggcaaatgcggcagagatacatacctgatccgcaactcgtctggatacaaagggtgcaaaggaatggacataggggcgtataccgatgcgtgacatcgccgcagcagccgctaccatatttgcttcacagatgccaaaattaacggtatgctctggatacttatcatacaaatatccggcgcctgatgaccctgccaaatccgcatcacaaaccataaccggcctgccttccaaaatcatcttttccaatgtttgaccatatgcttttcttacttcactgatttcattgttctgtgccagcttccagctcatgtgttcagctcctttcctgtaaggttgatataatcctgaagcgcctgcttgtctgcttcattaaatgtcacatggtgtggattctcctgctgttcaaaataaggaatcccggcacccttgactgtgtttaataagagcgcgcttgcctgctcctttctttttatgcattcggagagctttccattgacagcctccactgcgtttccatctacttcacacacatggaaaccgatactttgaagcagtgcaggaaaatcaaagtcacagctgacctttcgcaataagccgtctacctgcttcttattacagtcaaccataacaatacagttgtttaatcgtttattagcgatgaactgtaacgcttcaaacacctcgccctcattgcattcgccatcccctaccatacaaaacacatttccttctctcttcatcgtcttcaatgcataagcaattcctgctgcctgagaaatcccctgtccaagggagccggtcgttacctgaacaccgggtgttttcatgcgatccggatgagaaggaagcaaagtgccgttttcattcaaggtgtgaatatgcttttgatccagtctgcctgtcagcatcagtaccgcataataagcaggtcccgcatgccccttggataaaacaaaccagtcctcttccttcatgtaatttccaaacagaactgccaatgcatcactcatggaaagagcaccgccgatatgaccatcaccgcgataaagaaccatatcgcaggttacccttcgtattttgctcgcaaaagctttcaactcacacgtattcattcaacctttcccgcctttctgtaaatcgctttaatgtcctgtaatgacagcctcttcagttgtccgatactgtcagagcgaaggagacagttttgtgccatggtctgtatgattgcttcatcaatacacacgttcaaatctgtgatacaaactggcatgcccactcttttgaagaaggatacaagcgcctggataccgagcgttccacagcgatcatcatttacttcctctatacccatgacttgacgggcaaaggaagcaaatcgtttcggatgatatggccggacataggcagcccagcttccccataaggcacacaagcctgctccatggacaacattaaataatccgctgagctcatgctccatacgatgacaggcccaatcttcttttctgcctgtccccaacaaaccgttatggcataaagagcccgcccacatcagattggctcttgcctcataatcctgcggattttttatacttttttcgatactggatattactactcgcataagaccttcacacatactgtcaatcagttctgtgttatcagtaggagagaaataacgctccatcgcatgcatgaggatgtcacaagctccgcttaccatttgataatatggaagtgtgaatgtcagtattggatccaaaatggcaaatacgggatagagttgttcatcatcacaggctcttttcaaattcccttcatcaatggtaatcaccatagaacaacttgactcactacctgaaccggcgattgtcgatattacgccaacatcaagcgcctgttttattttttgatcttctaagaggatatcctgaagtcttacggatggtactgccaagcataccgctactgcctttgctgtatctataacagacccgcccccaagtgccagaatcacatccacaatatcaccctttacgtttctgacaatttgctcgacctctgacagctttggattgggacgtatccccccctgtacaaaataggaaatggagcaggactctaattgcgttgttatttgctctaaagtaccgttttccttccagtgggatcccccgtacaataccaacgcagaacgatatccgcgctttagcagttgatctttcagtgcatgcagacggttcctgccaaagatgatttctgttggatttttgtaaataaaattttccatggcatacctctagcgatatttatcggcttgtccgatacacccgaacagctgcattttatgagtaatgacccttttcgcctcccgtttgccagatacaaatacatcaggtgtccaaaaagcatctgtttctataagcatctcctttgtaccctgaaaaaatgctttgcgaacatcacttgcaatattgaccttgcagattccatgacgacatgcttctgcaatttcctcatcgcggtttgcagagcctccatgtaaaacaagaggacatgtattcactttttcaattgctttaagaatatccagacgaagcctcggcacaaatccttttggataaattccgtgtgctgtacctatcgctacagcaagcgtatcagcattcgttctggtcaaaaagtcagtaacctcctccggtttggtatacgttacctgctctacgcctccctcaacgctgtctgataacgcgccaatcgttccgatttccccttctactgacacatcgacaccatgcgcaagctcaacaactgtctttgtgagttttacattgtcctcatatgctaataatgagccgtcaatcattacagaggtaaagccgcagcgtatcgcacgtatacaatcctgtatggtctttccatggtccagatgcaggacacagggaacactgctgttttgcatccgttttacagcataggcgaagaaatccgatccaacatatgaaaattcaggtggtgcaagctcaacaattaccggtgcatgttgctcttctgcacattccataacagttgaaaacagaagactgtcgcatacattaaatgctcctactgcaaaatgatgctttctcgctgtttgcagcaagctctccatattcatcagcatttttcatctctcctttctgatgaccccatcataacgaggatagaatgcaccgtcagaattgttgaagattttctttatatttcaatacatttcaaccttaatccactgctttatcacttctttctgaacttttcaacatatctgaaattcatttgtaccaggataagcgagtggtgagcttagtgaaaaagttatttaacacaataaaaaaaatatatactgtcctgattttctgttatttttcatctctgcctttgccgctgattcaaaaaaatactgtttcttctataaaagaaggtataacctgtcataatttgaaccatttccgtgataacataaaaagcactttttccatgataaaaagacactgcgttttctctcgcaatgcccttatatcactattctaaattagcatgccacatcatttaatcactactgctctgtcagctttcctgcatcatcataaccaccatggcatcacagcagatccaggcaagcttttcatacatggagccgctcatctgtatgggacgcccctgaatttctgtcgtttccttggtgactaccaatattatgaatttgatatctgtcatcgatgacagcgcaccagctttattcgttgtcagcagtgcgatgtccgcatgcagtgaccttgctttttctgcaatgacaaccggatcggatgtattttaccgagccggacagaaaaccagcagatcatacgttcgtactaccccataagtatctatcgcatggaaagacctcttgcaataaagccgctcctgcctgcccagcgacatacccccgtttcgcatttaatgcaccattatctccagttctttctttactatttctactgctcgctgcgtcagctccggcatgatgaaagctagaacatcactgctcaccgccatgcaccgcttcatagatttttcttgcttcagctacaggatccagtgcatgcgtgattccagaacctacaataacgatatccggacgcagcgctgtgtaatcagaaattgtttttccattgattccacccgcaaccgatacaccggcagccttcacgcactccttcatcagcttcaaatcctcaagcggctctcttccagccgcctgctgatctgcaccgacatgaaccgcaatgatatgcgcctgaatttcctccatctgcgcaatctttttaggcatatcctctacacagatcatatccacaacgacctgcttaccatagcggtttgccgcatcaatacagcccttaaccgtcaatatatcggtaactcccagcaccgttacataatcagcacctgctttcagcgcttcttccgcctcataatctcccgcatccatgattttcagatccgctagaatttccttttccgggaactcctttttcatcacccgtactgcttccataccatattcaataacaaacggtgtgccaatttcaataatatcaatataatcacgtactgtgcgtacaagtgataacgcatcctccaacgtgatatcgtccaatgccagctgtaatatcataaactaatcctcctcatttctgtaggatgccaggaagacatccatgtttcctttaaatttcagcattcccattccttccggaacgagcagggtttccccttttttgataggtacatcctgtatagttccttcaccatccacacatgtataaaaggcaaagcgaggatgcgagaatgttcccattttctcaacctgaagacgcataagtgtatacaatccaggttcatcccagtaccttgtcacatgaatgccgcgctccagggaagacggatacataacaaattcggtggaggtatccggcatatttacattttcatatacctgctccggctgaatatcacgtttttttccggtagatggatcaatgcggtcataatcatacagacgcagtgtacaatcagcatttcttgaaatattataggtcaatacaccggttccaatggcatgcagtgttcctgcaggaatatcgatgaatgcatccttaaccgccttcagatatttcaacaggccctcccaatcctgctgctctgttttctccttgaattccgctattgtctttgccttgtgtccaaactggattctgccttcctcggtagtatccagaatgacccatgcctccggttttccgcggcctccgttatatgctctggcaaatgcatcatccggatggagctgtacggataaatcagccatgggatccagaatattgacacgtaccggcagctcctctgtatcacagttaaaccactccggatactgtttgtataatgcagacagtgtcatgtccattcccgatacctcacaatccgcatgaccctgtaatgcgaccacattatagacctcccccagcggctttacatccgtatgatagttgaattcattttccagacgctctccgcctccccacatacgcggttcataaaacggtagaattttaacgattttcttcatattcatcctcctgtgccatccagatcggcacgtttttttcgtaatgctcataggctttcgcggatagagaaccatccgtgatgataccgtcaatttcctcccataaacacatggtatgaaatccggactcccgaaatttatcactgtctgccagtacatagattcgctcactctggcgaaccatggcttttttcgcctccagctcctgataggaatgtgttgtaggcccttttctatccagaataccgctcgtccccaaaaagcagatatccgcatggaccgactcaatcgcctgcacgcaccagcttccggtcagtgaacggtttttctcccgtttttttccaccggtgagaaatacattatgacgctctgcatccagacactcccatgcgaggagtgagttagtcacaatatcaagcgggcgataatcattcaatagctttgccagctcatgcaccgtcgtaccggcatccagaaaaacgactttggcatcctccagaaagccaagtgcacagcgggcgatttccttttttcgggagccatgccccattcgtacaggcagcgcctgctcaatatcctgccgggataatgatgctccgccatactccctgtgtgcaatgccggcagcttccaggaaggttagatccttgcgaatcgtttccatgcttacctgatactgcttagcgagcatctgcgctttcacatagccatgctcctgcagcattctgatgatttcattccggcgttcaaaggttggtatcttcacgttttttctccttcctgatgacagtatacgaaattttcgccatcaccacaaattgcgattagttgcgattttcttttattgtatcacaaatattgcgattgcctgcgttttaaaaattatttatttctagaaaagccatataaaaagtatgcgtttgctatactcctacgcatacttttatccattcaccagtttgattatataactacaatcctgccttttctcttgcccgggtgatgatctccatcacaatcagactctcctgctgtccttcctctacccgtttccagtccttttcacgcacaatgcgttcaaattcgatgaattcaaacttcatgcgatggacatccggatgcgagttgaagcgtccttcttccttcgtatcacggtatgtatatgccaccgcagagcatacagaggcagagccctccacctccagatatccgttttcaccttcaataacagcctgagaaggtcccgcacaatcctttgccgcaatgcatacggatttaaagctgccataatccagaatcagaataccggatgtatccacacgtttttctatattagcgaaatactggacatccttcggcatcccgaacagacctgcgttgaaatgcacattgtacacattcagatccatcagtgcacctccggccatatccgcattaaacgcaggtagaacctctccacgcttgaatgcatcataacgggaagaatactgtgaatagttacaggataccacatgaatgcttccaactctgctcagttgtttcttcagctccagataattcggataatactgattcgtaattgcctccagcagcatgacattgtgctgctttgcaagggcaatcagctccttcaattcatccacatgtaccgtaaacggcttttcgcagatgacatgcttgccggctaaaatcgcttttttgctgaattcataatgcagatggttattgattgccacatatacggtatcaatttcatccagcttcagcatttcctcataatcggtgtatgtatgggcgatcccatgctcctcacttaatttcttcagcttttcctcagagcgcttggtagcacaaattccaagcagttcgattccttcgatgtcatgtacaaattccagcagaccctgtacgacgatcatgcctgctcctgcaattcctaatttcataccagttccctcttctttcttacccataatgtagcatatcttcccgtttatgtgaatatctgttttaaatttttagtgagtttctagaaaacaaaaatgatgcatactgcttacttctattcatgatgctgtgtagagctatcacgcgtattcttatggcggaatttatgatacaagattctgtgcattgcatacatatgacgcgaacagaaatccgcaggctggatagcggattatatattttatcataccacctgtttcacaaggtataagcttcgcctcactgacttcagcaagtgcaatcatcgttataattactacatcattttcctactaagctattttctttttttcaatcttatcccattctctgttttcacaccagtataccgtattcgctgccggatcaaacaccatggataccaccgtaggacagatggtctgtgcagtctgttttaaaacctcaaagcagtctgaaacatcaaaatcctcacttctattctccagaagctcgacagccttatgatatctgtccagtcccatccaggggtgcctttccgtgcttcctttgaatggtgagaaatttgtaagaacggagtatttcggttttgatgcataccgtattccctgccccggaatgatttgtaaaacattaccggagcgatcggatagctgtgattgaaaggtgacacccggaacactcgataccgcttcatgctcagcgattgctttaatttcatccagtgttttctttctaagcagtaagtcgatatccagattgataatattgagactgtccgcattcgcaggattacttctttcatcgaatggccagcatgtcggcatcgctacaaaatctcctctggaattagcaccgaataagggcagccagccttcttgatcgtcctgtatggcaatatacactttatcttcctctgccttcacccgatattccatattcaaaatatcaagattaaagccgatgattgttttattgccgtttgaaattatacttgtacacatcgtatgtatcctcctgttgttttctctatattttgattcaggatggatgcttttgcatacactgaatctgtcggtatcaatgacatatccgtatcatagcacataatattgtatttgcggggaaaagttcataaattgtggaccgttatccttcagaattcacatgatgcaggtgcttattatttcttatatggaagttctgtgtagggcagtccttatgcaacttttaaatttcaggataataaaaaacaggtcccctatgctcttcaatcgaacataggctgtacctgtctctcattgattttataaaatatcctccagctttttttgatcgagaagaatcaaagcatgcccctcgatgcggaagattccttccttttccatacgcttcagctcctgattcaaagaggaacgactcacatgcagggtatttgcccagatggtctgtgaacgcggaagcggtatccgttcatgctctgacaaatgattcatactcagcagccagtatgccacgcgctgctgaatcgtctgatacatcaggcagctcagcagcatctgattgcgcaagccccgttttgacagatacagcataaacgccgtcatcatttccgtatcctccttcagcatttcctccagatcggatacatgcatccaggcaacggttgtccgtcttactgcgaccagcgtatacgtatactgccgctttcctgtaaaatacagcagctcaggaaacacatcattatcctcaaaataggcactgcacagcacacttccctgactggtatactgctccgcctttaaaacgccatccacaaccattccgaaatgatcaatcgtgtcattgatggaatgcagaatctgcgagcttttataggtttcatactgcagccttttcccataaatctcatggtgcatgcagcggtgggcaaatatcggcataagaccatagggttccttgcgcatggaaatcctcctttatccgtttacagaatcaggcgaacaccgcatccagaaagtcgcagacatcatcgtaatcatgctctccatgaaagcgccgcacctcttcaccgttgcgatacaccgccacaacagggattccctgtacatggcaggcggcaacgatatccttgttggcatcaacgtccacatagcgaatcaggaagctgttcgcaaactcctcctgcagggcttcttccaaaaccggatgcagtgccttacagtgtacacagcgctctgcaccaaacagtacaagcaccggcttctcctgctgcttccataccttatccttccactccgccatgccgctgaccggttcaaacacctcagtatctacggagaaaaccttttcgcgccggctcaaatcttcctcatcatcggttgccacacacagtgccacatcctgataatacggcagggttccttccacatcaatcaccgtctttgcgccaagtgctccggcattcggcatacggaaggtggtattgtcaatacgtggaattgcaatttctgtcggtgtcggctcctgtggaacatagctgtacggatagcggtagccgcgataaatcatattgttcttcggacctgtttcattatgcgtataatatggcgaaatccactcccatacaatttcatgatctgcggttacctctattatacgaccatcgcttccttctgtcacgagcgtatttccattcggaagacgctgggcactggaaacatagggactatagaatttgctggcatcggttggtatggcatgcgcaagctccttcggtgtcagcttccacacaacctccagtgtaatcgggttaaactccagcacacggctgtaatcccgcagcgcattcttggagccgttgcggctgcccggattcggaacgccatagcctccccagcctccgttgtcaaacaccatcaggtttccttctcccggaagacccttcggtatcatatggaaatgatgctgtccgatgatccatccaagcttcctcaattccggagttgcattgaaatccggaccgattttccacacgatcttcccgctttccttatccagaatggcaaggatattcgcctcacggcagtcaaagatgacattgtccggcttaaagcgcatatccccatgttcataccatttattcgggccaagatagctcatgcagttcacatgcagataatcgccgacaccaccgtcactggaacgcatattcggatcgcgtgccagaatattttttgcggcctcatcgaagcccagctcatcaaaatgatccgaaatagaccatttccataaaatgtttccttcccaatccacctcaatcatggcatcatccagcagcttcttatcggagattgccggatttttaatggtttgatgaaccagaatcagggtattcccctccaatggctttgcgtccattcccggcacataatatccaaccggattgccttccctttgataatcgtggtgctgccgtgccatccagcggtgatctcttccgggatcgttgatatgttcaaatttgtcaaattcccagacgatattcccatcgtaatcgatttcaatcagattcacaccatcctgcattccgtaatccggatggcggtatccgctcagccccatcacatagccgccaggcaaaagcttaggcggcatggcgtgcatattccatctgcgcacctcattgccattcatatcaaacaacaatacaccgtcattgatcaagggtacgatcgtgtacccgttccagcatttctgcggatcatatacggttactccgtgtggaaaaacgtaaggctgtcccatattgcattcctccattctatggttttgctatgcctctttaccattcttttttatcaatttcccatgttcaaacattgcactggataaggttccatccatatgcagcagctggtacagcagggtctgtctggtgatatcctgacgaatgactgtataatcatcctgtaaggcctcctccagctgtgtcacctgttcaatctgtgagctttcatacggattatagaatagaaaagcaactctgccggaatccggtgtcagaatgctcttcagctgatttctctccctgcaataccgctcacttgccgtagcggcaatcgctccgtctgcggctgcggtgaccacctgacgcaaaaaggtctgtgtgcagtcccccactgcataaatgccgggaacactggtttcctttttctcattcacaagaatatatccctttgcatcacaggcaaccacattctgtacaaacgctgtctgcggcaccatgccgacaaagaagaagataccgtccgcacgcacttcccgtgtttcaccgctgacaacgtttttcaggattaacccgcggacctcctcatcccccagaatttcctgcagggtggtgttccagacaaaatctattttcggatttgcataggcttcagccgctgccatttcattacagtcaaggtgccccttctcatgcaggacgataacggttaccttttttgcgaaatgcgttagatatccgctttcctcaattgcctgatcgccggctcccagtacatagatttccttatcccggaaaaactccgcatcacaggtagcgcaataggcgaccccatgtccggcaagctcgatttcattcggaataccgagaaccctcggcttcgtccccgtatccagaatcacacagtcaccgataaaatctccgcggcgttttgtgtgtacaagaaacgcaccgtcctccatcgtttccaatccggttaccgtagtccgcttgaagacattggtggcatacgactgggcatgcgccttgaatttctgcatcagacctgcaccgctgtcagaaataaagcccggataatttcggatttctctggtgtcgttgatacgtccgccaaagcttcccttctcaatcatgagggtttttcgtccggctcttcctgcataaatggcagctgccagaccggcaggtcctcctccgataatgatgacatcatagcgttcttccatacatcctcactcctttgcatgatggtatgtcatactatatttatgttctccctctctccctgcaccgagcacgacccagataccgcagatcagtgtcagaagcagacagtaataggaggacaggaaaatttgaaacggtgtgacaaccggcagataggcatgatttgcggccagctgattgatcacagtaacagctcccatgacaaaggcgctgttgattggtatgattgctgttatattcgttgtcatcgcagttaacagaatactcctgcgttccggtgatattccggccttttttccaatggtatccgcaatatccttaaacatgagaatggaaggcagcacacagcctgccaaaagaatattgacgataccgacgccaagggaaatcatcgcctctgcaccgcctacatgctgtagcgcttttcgtgatgtgagatagttgcagcatttctccatcattccgccctctacggcaatcgcaatcagaccatagagcaggatggtggaaatgatgatatcgaccacgccggataagccgtcaaacagaatgccgtgcagctcctgtgtttcatactgaatgctgatcagatcagaaaaccggaacagtccggttgcgattccgacgattatacctgccacaatcgcataggtgacgccgacaaacagatcacttgttttaaagcagattatcagcagaagcagaatcggcagcagcatccacagtccctttggattgcacatgctcgcaagcagctcgggattctgtgcgcttccactggttcccaaagcataaaacagaacagcggacagaattcctgcgatgagcagatacggcagacgctgtttcattacacgcagcaaatcagctcccttgtttgtgacaggatcatgctgggaggcaatcgtcgtatgaatgacctgagagcttggggagagtgcatccccaaagaaaatgccgctcagcatagcccctgtcagaatcgcaggatcagcgcccatcagcacccctgccggataaaaaatcggcacaacggccagaagtgccgcaatcggtgcacctgcgcccatggaaataagcgaggatacaagaaaacagaaaaccgtgaagcttcctccgctcaaatgcagatgcatgccaatccagacaaagccggagccgatctgtccgacagccagaagcttggaaaagataccgatcaccatgaagatcataatcagtctggcatttccatactgggcaagaccgtgtacgatggcatcccagtaatgcgccttgtcagcacataggaggaatccgatcagaatggcaagtaccgccgccagaatcagcgccttcatagagtaataatgaaaacagatcatgatgataccgctcagcagaacatacagtacgatgggcagtacggcgaattcctgatgcatatggaatttcaataaagcgtttacatcgttctttttcatatagccaccaaccttggatccacccctatgataacactccctttttcctgttacgtgttggcattccaacagtttctcactttttgtgaataaaataacaaattaaaaaacagcgatttttcacaagaaagaggttgggtgaacagtacagaatatgatgtgccaattgagaacagaggattttcagggctgtgcaaatgcagagcagatgaggaaaagcctttttctttcacagcggacatgcaggaaatgtatagcgaaatatgtgtgccgtatacgacagcaaggcgttttcgggaatatgaaaaaaagacttcgtttttaatcaagtgaagtctctgttctcattcattttcaaaaaagagaaatgctggcagcatgtgtgcgatctgctttcttctctgtacctatagattttgttcccgcatgtttacggctcttcgcccgatctgtaatcatagcgcttctttatgacacacagatcagattttattcatgaagtgtacctcttctttatgtatattcgtatatattcgcataacttgatctctgctgcttttatgatagatgagatatccatctgcatccgttttgaagataaccgtaagctcgccaaccttacaggtatgcaattgatcatcatccgtttcgcagatacgcacatagtcctcaagtgcagcattctccagggtttgttcaaaggtctgtttgtcccagcgtatggtgttgaagccctgaggcagcagaccggtatccgctatgttcacctgtgccataagccctgactgctttgtctgttcgatatggaaagaagctcccttttcatccgtataggtgccgctgaattcataaggggcatatacatcgtttggcttggctgtagtatcctccgtgctgctggatttacgaatactaagatctacaagctgacccttttcattctcctgcttcaaatgaaagctatctgcggcttccagtttttttaaggctgtatccagctgtgctacagtatccttgtccttctgaaattcctcgacatccctgtcaggctcagcgctgcatgcacagcatagcagcatcagtatacagcatccgattttcttcatcattctattgtacatttgcatgccgattgcttaggctcgcactccttctttccttaattgtacacgagaaaagctgaattgtcttccatatagttaagattagacagcgttttattcagaagctgcttctattatggctgtaatcggagttagcttgccaactgtgatgcttcgcatacttctgaagctgatacttttaaaatataggataagcttgatgagacaaaatgtttttcaatatattttattttttacgttcattattatggtaaaatggatgcataggtaaatcaaagttaggagttattatatggaaagtttagataatatgttaaacattggaaaagaaatgaaaagaaagcttttctcaatcggtgtcaggtcatcagaagatttaattagactaggtagtaaagaagtgttttctcaattaaaagaacagtatccaaacgtatgcttagttcatctatatgcactgcaaggtgcaattgataatgtcgattatgataaacttccggatgaagtcaaacgtgatttaaagcaatttcatgatcgtataaaagataaatagaagtgcataaattagtttttattcaatggctataaagataaatcacgattggaggaggtattttatgtttaatgaagtatgcatatatgaggcaaagctgaccaagttagatgaaattgaagaactgatgagggaagtggcggaattttacttggagcaagatggtgttattgatgtacattatataaaacgtactcacagacaaaaagatttcaatgcagttaaagagggagaattacctgttcgtcttacaagaaatgtaggtaaggtaacatatgtcttgtattgggtgatggaaaatgaagaagttcatgcaagagttggaaaactgggtttggaaaagttctataagcgttggaataggtgtttgatcacaatgcccaaaataattctgggtgagaatattgtttgatttacaaatttcagtttattgaacttaaaacaaggaattatggaggttgataacgtgaatacacctgcattggtaacaaaacgtttgattttacgaagattcacagaaaaggatatgaaagctcttttcctcattttgaaagatgaggaagttaataaattcttaccatggtatcctttgaaaaatttagaggaaacaaggaaattttatgaagaaagatatgctttgaaatacgtacagccgcaggcatatgcgtatgcaatctgtttaaaagaagataattttcctataggctatgtcaatgttgatatggaaaaacatcatgactttggttatggacttcggcaggagttttggcataggggaattgttacagaagcagggaaagcagtcatagaacaagtgaaaacagatggtttgccttatattacggcaacgcacgataaaaacaacccgagaagtgggaatgttatgcgaagggtagggatgacctatcgttattcctatgaagaacaatggcagccaaaggattttcctgtaatattcagaatgtatcagctcaattttgatggtaatgaggattttgtgtataagacgtattggaatatgtatagcaatcatttcattgagaaattaaaatttgataagaaataatcataatagattttactgtttatatcacattgtgacggatataacaattatttttttgttaagcatgctgatgaaaagcgacattccaaaatacctgaaaatcaaagcagaacaggtaaatggtcttttcctgcataaaattttgcaatgctttaccatctttatcgatttcacttttccttcagttgtctaaatctattcactatggagtaccataagctataaacaaaaagtatgacattatgagaatgcagcttttcaacaccgctaagacagatcgtgagtattcctatgatgatgtcaaaatgatatcaaaatagaaattttaagtagccgttacctcaattttatgatataataaaccctgcaaatgatgtgcccgtagctcaattggatagagtatcagattccgattctgacggttgcaggttcgatccctgtcgggtgcgccagaatattatagaagccctgttgttcagggtttttttctattccttatacagcataagaaacaacttgcgatttcttcacattctgtccaaatcagaatgttttagaaaacactcgaaagcattatgaagtatagctttatacaaatagtcacttaatatcattttaagtaagactacttcatgattacagtatctccctaataaccatttacagaataaaagcggcgagcagacgctaacgcatcaagctcgccattatttatttacagtgtgttccttttcttatttttgaggctgttaaaatagaaatcactataccagaagctactaagagtaacacccaaagcgatctgttagatttatctccggtttccggtacttcttttgtccctggtgtgttcacattcactgaagactccaattcattctccttttcattataccaggaaggactagttacattatcctttaccccctcatcgatatcaacactatcctttctgtaatacaaaaacttggcaaaagctatttctccctccttaatgattccagtttctcccgatttttccaccttgtaggctttgttgttatcggtatcctctactgtatagcgaattccggaaggaagacctttagcagcaatactctcttcatgcttcaaaacaatgttcgctacaccctgcttaaatctcatgtctccataaacacccgtaattctcttatcactcagagtcacggtaaatgtaaagtcctttttctgttcttcttcatttccggctactgtattggaaatcatcagacttccggttttaacctcaggctctgttggcgtactgttcttcgtattaaggaactccactgtagaagcattcgttgtaatcttgcctttcgcaccttttgaggttgtgatataaccatcctgattactttcaacctcaacgacttcatacgctgttcctaacggaagatttatggcagacttacgttccccatgcttcagagtaaattcgtctgacacaccactcttgaagcttatatcaccgaacaatccgttaatttttgtatcctgaaggtatactcgaaaatggaaatcctttttcgtatctcccttagttccatctacaagcttagatattgtcagattaccacctttccattcggcaatcagcttcatagaagctgtctgagccttcacctctatgctgtcacctggttgatacactttatctttatacttccaaccaatgaatttatacccgtctttcatcggagctgtcttaaccatatgcgttttcccaattttaataacttcctcatcatatttctcaatgccatccggagatatgccaccggccaaatcataggaaatgactccccagtcctccagagcatcggccgttccattaccatcttcatcgaatccccaggctgcataaactgttatattttcttttccaaataaaatctccgtgattgtttccaattcacaatcattccattgatagattttattgtttttctttgttgtccagccaatgaaaacaacagcctttccatctaccttactatgcattggcttttcatttgatagtatcgccttctctttcggcaaatatttgttaatatccttcggcatgttctgaacgattccatcgttaagagcattttctgaatataacagctgtgagagtgtctccgtataatctgcctggttatttccattgcgatcttctgcccaaactgcataaagtgttacattttcagtacccatgacgatagtgtttccgctaatcaatattttttctatgtcggccttttgttctgcagtaaaagctgcgctgtatggctggcgactccagccgacaaaaatttctctcgcattacgtgtaaagcccttctcatctgttatagcaatactctcaccgtgtttgatgccgtttttctctgccggtgtagttccattgccaccatttaaatcatactttaaagaatatgtctccagtacatcagcagtaccgttgccattctcatcatagccccaggctgcataaaccgtaacgttttcattaccaaaggtaatttttttaactgtttttataggtgtatgattccgttcgcagatatgaggactctgtgttgttgtccagccgaggaatactacctttttgccattcacctcactgtgacttggcactgtttcgctcagtgaagccttattacccggcaaataaatcttgttgtcattggtaggcatattttcaacgttaccttcgatgacattggcatcatataccagctgatgttcctccagatagtctgctattccattattgttgctatcagcagcccacacggcataaacattggtatttccatctggatctgcagcatccgtttccagcatcgttacttctgtctgtatgctgtctttcagcgtttcatattcccttgaatttgtaataatcgtatcaagagtcggtttaatactccatcccacaaaaatatgattcccgttttcaaaggtaaagcgtccagatatcccctccgtgctccctaattcatcatgctctatctgcttaccagcaatatccttagcagttgaggatagctgtactttctcacctgctacatgataatgaggacaaatcacatctttacgatcagaagcagcgtcatggtatcgaacgtgtacagcatcatcattatagtcaggatttccattaccatttccatcgattgcccataccgcataaagcgtaaggtccttttccggcatcgaaagctcatcatcaataataattttgttaatgacctcttgtgaagcatccgctgataacggtgaggatattttttccttactccaaccggcaaagattgctccttctcttttcaaattgtccggctttgccgctattgaaacagattcattggcaatgtgcgcagaggatcccggcacatcgccagtgccaccattaccatcataacgtacggtgtaaagcttgtttatctgagcggtaaacaccctatccttcacgatcgacaattctttgagctcctcggtactatatactttattatcggcatcagaccattgaccatcaaaacgccagccatctgcttctttaacagttggaatcgttccaaccgtatttttgtgccatacctttatacttgccttactgattgtagcattttctgctttgaaagtaatcgtgtgaggcgcttgaagtccaattgataaattcgtattctttttgagattttcctcgtcacagttaacaacaatggtgccggtagcactattgttgttgccgtcttctttaaatatcccatcttccggcaacgagaacttcaaaggatatgcgctatttatatcagtattaccggggtttgtaattttcacatggtaggtatcagctcggcgtccggtaaatttaaaagttccgttcttcgcagttgtttcatgactttctgtatcgtcacttcccactgcattctgatgaggcgcttctatctttacatcacctttgtacagctcgtccgtatcctcatcataaacgccattgaaattcctgtctacaaagatctttccttcaatgattcctgtctggaactccgcttgtatatgcggcaaaggcatatgtccaccgttttcttcattacctactgtatacggcgtatacccgcaaggcccgaaattaacaacactacccaccaaagctgatgttgccttttctgcttcataatgcagatagatttttatttctgcattatttggtatttctgtgaccgtatccttcgcgctgatacgaagcatttttactgtagaccaatccgatattttatctgcatctacataattatctttattattataatagagcggatcacctatcgttgctttggaatcaactgttgtactatactgcacctgcaaatcactttgagagcttcctatcatcgttgcaggtccactcattttcatattaaattcaaacggcttgtcctgaatatgggtatcccagttgtctcccttcttgggtactggaatataataataaaaggcttttgcgtcttcctcaccaaatggtctgccggtttcgtttttggcagtaaaccgaaaatcaatgctatgagtatcttcttttaaaaactcaattttcttatctatctcataattggcatatccttcatcgctgatatcagcagaatcaccctcagacagctttgcgccaaagccaaagctcagaccaagacgcgccgctacgattgataactttgtatcatcagcatttttattaaaggtacaaaatttctctgttgtatccgcatcgccatcccaatcatcggtatctgactgtatatattcactctgcgtaccaccggcattatcagatgccagagatgcactttttattcgcacacagttccgcatatccagggccatggcatccgcaaccttatcaattttcatatcgaaagacagaccaatctgatactgtcccagattctgcgtaaaccagccgaccggagccttgccactctcaaatgaaattttgtacattctgtaatcattcgcgcattcactatcaagaatagtataatccgtcttttcctgcaatggagcgctttttacctttccagtctctggcgtaccatcccctaacaggacgcgatcagccgtacttccttccaatctggttagcttcaaattctctatcttaatggattttggtaaccggatatagatttccgtatccattaccagcctatgaattgagtacggatacgccgtggaggcgataacaccgttgaattgaactgtctctccggcagtcgtggaatgtatatccaataccggaatttttttgccattctctattgtatttatcagcgcaagagacacctgattgctctcattggctgaaacaaattttgcgtcgaaggtagctggaagaacagtttcatcacgggtttgcgtatcatacattttcatagtcgcaaacgatgggatatttttaggttccatggcttttttaagctttcccaatgttcctgcacaagctgaagacggatctgctgttcgagactcgacatagcccatatagttagcatcataaacaccgacatttgcgcgtatattggtgaaatactcgtccttcttgagccctgccatttcagcagtgaacaaagcaaagccgttactacttgtaagtgcatgggagtatttcgtttctgacgtcttgttcgtcgtataccaaacctcaatctgattcccactggtagcaggaattcgctgcgcaattactccaagttcatccgagtcctgataaataaattccacagtctgtggttcactctccattgtcccttggttagacacaagaaactgcccgaggaaatagaccatatccggcgctgaatcatagacgctgacaataccagatttcccagaggtaccagcgcctgagcttgctccctgcatccttatatcactcgcgtttccggccttgaattgatccaaattttccttattaaaatcgttgtttaatatattgacagtattcgcagtcgtttcataaagaccgtctgcataggtaatcgttccacccacagctgtacgattaactgtccctgttccgtccgcctttataagttgaatattcgaatttctccactcaattttatctccagcatcacaaggctctccatccttccaacgaaaataaggcgtgaaataatcatcccggggaatatacatgttttcccagatcaaagtaacagtatgattgatattgtcgattttctcattaaattgaaatttctgctcatccttgtgatgaacaggatccatccagttatcgccatattcctttgtatcaaaatctgtccgcacatactccgcataggtgccctttgtactattgtacggcagcgcgatagtaacctccagtttttgaaagaacatccccatgctgtagcgggttctgtccgggcgaaaacgaatctgctgcattttaaaaggtgtatttgctgctgcaggaactattctctttgaatcccaagaggtcataacagggccagaagtaagcttgtcacctgtgattacagcttttccggaaaccttctgatactctctttgttcatccccttgtacggaataaacgctgacttccaatggatttttcatcgttgagccaagtttcttattccaaagtgtggtatccggtgccaaaatgatattgaagctgctatattctgctgtatcacgaagtgaataggtaatcgtaccggatttagggcgatagcttccataggtgttatcactattcaactcttcgatattttctggtgatacacttgctaccaggcctgtcatagaatttggttttggatactctacgacgatcagaccgtccggaacgtttatttccacccttttattctttaaattcagtgtgctttgaaccttgacatgcagtgttaccgacttcgtataatcaatggtaaaaagagcattttcttctaacaaggattgttccgtacctgcatcatctttaattactgccgtcgtaatctgcattcccggattttcttttgccaaagtctttttcggcatctcggataacacattgtcagctttatgctctggtgcttctgttgatgcatcctccgtttgcgatgtctcgttcagcttatccgcgtcttgttgcttgtttgcatttgactcgggtatcttctcctcagagagaaaagagtcctcttccttgtactcctcagccagaacccccgctatatttgtaacaataatccccatacagaggattgcacatacaagatttctccctcgtatcttcttcagacctctcatgatcaatcactcactttctaaaacctaataaaaacccaatagtataataagcttcgttactcatataaaatttcaaattctaaactaaatcgcctttccataatctgctcaacttctaaaatataatatttcttgaagtctccacgctatccgctgatcaatttaaaggcaaataacataatcaatcgatgatataaaaggatggaatagaaggtgtcaccttattctgttaagtacatacgacatgtcttcccattatttcttttgaatattctgttccgcctcctccattaggattgcatgcttgataagatttgcatgccgataaaaggtagacctcttgatgttcagttctttttggtattcacttaatgcctccctgtcaactaaacgttttcttatttgtacctcaaagtcattcagcaaatcaattgatggccgtccataatttccttttccctctaattttctttgcaaagccttctggatgcctctatgctgactttccttcatcttcttgcggttcaaatctataatatattcataaaaggaagaaagtacagctgcatcaatgaccatcccctgaatggatagctgtattccgttttttgcatattcccgcaattcattttccacctgtatgacatcctctcccagagcggtgaatgatgtgagtttcaaatttttatgtttcatcccagtatcctttcttatgttctatacgttgcatctaatttccaggtgctagtgaggtcatacgaaatccaaaacaccactgcaggatttccatgcattatatttttacagcaccctgcacattataggaatccggttgattataggtgagatttgatgcaagtgtattacttatgtctatcagaccttgtataagcgttggattaaacacaccgcattctccatttacaatcatgtgcaatgcctttgtatgtgaatatgcctttttatagcacctttcactggttagtgcatcatatacatctgccagtgctaccacctgcgctgcgatcggtatctcttctcccttcagcccatccggatagccgcttccatcatatcgctcatggtgccagcggcaaatttcaatggctaccttgacaagctcggattcccgctgttccgctggtaattccatcagcatttcagcaccgatctctgtatgcgtcttcattacccgaaactcctcagctgttaattgttccggcttatttaaaattgcatcgggtatcgcgattttccctatatcatgaagtactgaagctgtgctgatgatgtctatatcggtatctgtcagcatatacggagtgctttggtgaacaagggtttccaacaaaagccttgttatcgtatgaacatgccggatatgcgagccgctttcaccattacgaaattctacaatgtgggataggatagaaatcatcagcttattatttttttcttgactttgatattgctgtgcgattatttcttcgaggtaatgctgccgtgcatataacagcattgtattcgctattcgatgctggacaatcgcagggtcaaatggccggcttatataatcaaatgccccgaagtcatatgcctgttttatattcgcaggagaattgtccgcagagatcataataaccgcaaggctggcattccagcttcttttttttataaaagccaaaacttcgaaaccatccattttcggcatcatgatatccagtaataagagtgaaaattccgttttgtagcgagaaagaagagctatcgcctccactccattttccgcttctacaatgtcatactgattctcaaggatttcaatcagaagagctctgtttatttctgaatcatctgctataagaattttttgtttattcacatgcatccatcgctttcataacaaggtatatttcacgattttattataattttagttgaacaccctgacaacatcccgattggtaaggtatacccatacgctttatacaaaattggtaaggtgaacaaatagcttcgcatatgcatactgacaaacagaaggtcgcatactataataatggaaaaaaaccggaaaggatatgggtatggaagcacaagaaacgaaattctcatttgtctatcatgaagtaaagcagcgcatccttacaaaccaaataccacccggcgattatatgccctcctcaagaatactctgtcatcaatttaatgtgagccgttataccatcaatcgcgtctttgaagcactgcaaaaggagggatatattgagataaaacctcgcatcgctcccatcgtattaccgcgagaagccgtaatacagcaggagaatgaaggtattgacattttgcgaagtcgtgataacattctacagttatatcagacatttgccttgatacttccctccttgttaagctttgcagcaaagcactgtaatctggaaattctgtatcattacaaaaaagctatgaaggtctcccgtatgggaatttccgccggagggtggcgtcctgtatcaaatctgttaaaagaaattctgacaattggaggaagtcccttgctggggaacctttattctgtctttgaactacattctcatttaagctttttcacagaaaacagtaccttttttctgaaagtcttacgaaaggattccatccccataacagcaaatcttatcagtatcctgaaagaaaaggatacacatgttatgtatactcagctgactcatcttcttcacaaatttgtatatgctgttcaagaaaccctgcagcatctggcagatacattggagacttatcccctgcagagccctgctgctttttcatggagaccaacgcgtggcaaggattatttctatactcgcatcgttagtgatctgaaccgcaaaatagtccgcggtgattatccgcgtggcacttttctccccagtgaaaagcaattggctgcaatctataatgtttctgtttccacaatacgaaaagctctgacagagctttcacaacgaggctttgtcagaacgataaacggaaaaggtacaatgattataaacccggatgatacccgtgtaaggcagatgcttcccaatccgggacgaacagaggaggcattgcggtacttgcatgctttgcaattactggcattgatcattcaccctgcaacggtgaatgctgccgcaaaattcaagaaaagggagctgaagagtttagaggaaaagctctatcttccggattctatctgtattatagatatatttgaagctattttataccatacggatgcacaacccctgaaaagcatactggaagaggcctttcgcctcacagaatgggggcattatattgcttattacgatcataaaaagcaggtattgcagacagttaataaaggactgcgcttagcagtacatgagttgcatacaggagactacatagaatttgctaatcgaattgctgatagctattaccacatatttcagcatgccagagacatcatgacaaacaaatacggtttttcttccgctgcatccatccagttaccggagaagtattattgaaaacttcatttgacagcatttgtatatctaaattttcagtagttactctttcttttcaacgatttctattgtttttcttttcctgctctacgttttagttatcgaaaatatcatcaattttattagaatgtatgtcttattttcacacactctatagaaaaacccgccatagcgggtctatttatcgttcagctcttggatcaatgcaggcaattcacgtatatcctgcactacataatcggcacctgcctgtatatactcctttcgcaggcgtgcacacagtgcttccttttcctgtgtgctgagtgcttcgtattccgtttgcatcagccccatcagagagcttccctccagaataccgacagagataacacctgccgcaacgccttccttaatatcggagatcgtatcccctaccttaacggctgcgtgtacatcacggatatgcagctgcttcaggttctcaaaaatcatatacggatacggtcttccatagttatccacgctgttcggtgaaatccagaaatccggagcatatcccttttcctttgcgacacgcgttacgaccgccatcatctgatctgtatacccagtagtagaaccgattgccagtcccatagcccgcagccttgcgatcgtttccacgacatacggcttcggatcggcaaactgatccagtatgctcatcagcttttccgtaaaggtatcatgcattgcatcgatatccgcttccgttactgcacggccgtgtgcacttttccacaatctcttaattctcggcatttccagcatggtcttgatgtgatcacgcttcagcatccccatcggctttctcgtttcctccatcgtaacctccatgccaaacgcatgaaatacctccgcaaatgcctgtaccggcgcaaaacagccgtaatctaccgtcgttcctgcccagtcaaatataattccctctattttcatatcagtttcctctgctttccatatactctttcataatctgtgccagccgcaggatatcctcctcataaatctcaccgatcgtcccaatgcggaaggtatccttatccgtcagctttcccggataaattgcatagcctcgctccttgataaagcgatacatctgtgcgaaatcaaaatctgtatccggatacaggaaggttgtgatgattggaccctgtaccgccttttccacataaggaaggaagccaagcttaccgaattcctcaatcaaaacatcacggttatgtgcatagcgtttacttcttgcaggaataccgccttccttttgcagctcctccattgccttggcaaatgccagaacaacatgcgtaggagaggtatagcgccattttccatccttctccatgcctgcccactgatcgtacaggtccaaggacagactgcgggcacagcctctggaagcgatcaaaagctctcttcttgcgatgataaaggagaagcccggaacaccctgaatacacttattggccgagcttaccagaaaatcaatatgccagtcatgcatcggaatatccacgccggcaaagcttgacatcgcatccacgataaagaccttatgatacgtcttagccagctcaccaatggattgaatatcattgagaatgccggttgtcgtttcgctgtgaatcattgcaatatgcgtaatttccgggtgctgcttcagtgcttcctctgctttcattcgatccggtattttatcataatcctgtgcaatatgaacgcagctaatgtgatgatagcgacacattgcggcgattcgttccccataggccccattgctgagcagcagcagacagccatcgtcaggaatcacgctggaaatcacactttccaccccgaaggttccggagccctgcatcagtacggttgtatatgcagtctcatcgacatgtgccagctgcagcagctctcttcggattcgctgcgtaatctgcttataatcctcatcccatgtacagtgatcaaacagcatttcctgctttacactgtctgttgtcgtaagtggtcccggtgttaacagcttgtatgttttcatttgtcttctctccttattttctacagccttcaaagaacgcctgatgctcttctaaaagctctacactcaatgctctcttaaatacccgcggatatttgcttgcatattttttctccacctgttcaccttcataaagtgcagttggataggtatacagaatatctcttctcccattttccataatgcagcgtgccattgccattgccgtcttattcacattttccttttttacaacggcaatgctttccgtaagggaataattgccttcaatcgggtcaatacagtcgatgggaagccccttttccttatccgcaagtgcctgatgccgcagtccgaaggcaatgccgacctccccggagcgcacctttttcaaaggacctgagccgctggattccagatgcggaccgacattgtcgaggattgcagttagaatttctttcccatcttcttctccataggtatccagcaatgcctgtacgagcagccagccggtactgcttgccttgatatccggtattgagatcagtcccttatatttcggatttgcaagctccttcagagaggacggcaccagcagctgcttttccttcagtacactcgtattcacaatcatcgctccctccaatgccgtcagcggagtatcgtaatcggaataggttttcagtgtcggcgtcgggaaggtcagcttatcaaacatgtcatttttttgttgggcactgtcaatataataggagctcatcgtaatgatatccgcttccagattcttaccctccgccatgatttttccaccaagctcgcttgttccaaacgattgcagaacatattgatcctgaaagccgttttcatccagtgcatgctgtatcgctaccagtgcttcctcatccgcattggagtaaattactacaggctcctttccctgtccgaatacgaaggtaaacagcacaacaccgccggcaagaatgccaagtgcatatttcttcacacggacacttcttgctttcttctcctccttcttctgtgtaacgaagagaatgattccctttaccagcagattggtcagaagaatcagtagagacagaacgaaaatctgatcaaatttcgcaaaatgctgcagctccttgatcttggttgtcagcactgctgtttttgcgccgacaatgaaaatcagggcagaaatcgtcaccatggaattgataaaataatagctgaacatctccggtatcgtgcttttggaattgggaacgaccactcgtcgaattgttttgaaccagctgtcccccatcagcattgccgttgtttcataggaggtattcagctttcccagtgtgttcttcgccatcacatacggtgtggagaagaaatgaatcatattacagagaataatgatccagaaggtgctctgcagcggtgtgccgctaaatgcgaacaggaaggcaataccgatgaccattcccggtatggtattagctatactgctgatggcatcagtactttttctgcacagtacaggaagcgtgctgcgtgtggtcacaagagcagagccatacgcaaccatggtaccacaagccgctgtgcccagggatacaatcagtgaattgcggtaaaccgacaataaattggcgcttgccagcgtatctgtgaaatgctgcagggaaaagctaatatcatacggccattcctttacaaacggcagcaggatgataaccgtaaatacaagcagaatactgcataggataagacctgagccaaggccgcaccacaaatcacgccccttgttttccggcagctcaatgctgctgattttattgtagcgaacattatagcgctccagataattcagaagaacgatactgatgatggaaggaagcagcatcatcatggcgacaaccgcaccgttgctaaagttcgggatggagccgagcatttcattgtacagcgtggttgcgacaaccgcaaactcgccaccaacggccgccgggataccaaagtcggtaaagctcagaaagaatgcctgaagaaaggctgccgcaagggttggaatcatcggtgacagggcggtcatccagaagcgcttccctccggaatcccccatgatttttgaaacgatgataaatttcttatcaatgaatttcatcgtattgttcacaagcaaaaaggcaatcggcagcgtatagatcacataaccgatcagaagaccgttgaagccatatatatcaaacagctgcacatgcagcagcttactcagcagtccctgctttccaaatgtatatataatggcaaagccataggtgatcgtaggcaagagcatcggcagagtggcaatactgcggattccctttttcagccgctgggatacatttgtataattgatggtgtaggccattagaaaggcaagcagcgttgtcaccagggcactgataccggataccgtaaagctgttgccaaaggcgttcacaaacttgccgctgaagatcaaatcacggtaatgctgcagtgtcagtgaggttccgctttcaaaggatttatacagcagcatggcgaccggcataaagagaaatacgagaaacaaagccgccagaaccacatagattccctttagctccagctgctttttatgcataggtttctccaaacaacgtaaagatattattgcgtttgatttccagctggttcaggatgaattccttcacgaagctgttttgcggatgctcgatgatatccttcggcttcgcatactgcgaaatgctgccatccttcatgatcagcatgcggtcggacaaggtcagcgcctcctccggatcatgtgtgacaatgattgttgtcaggtgaaattccttggcgatcgttttgatcttctccttgatgctttccttgataacaccatccagcgcacttagcggttcatcgagcaaaagaatttttggtttcatgaccatggttctggccagtgccacgcgctgcttctgaccaccggacagctggtcgatgtgcttatccagatgctgagaaagccccagtagctcaatcagctcattcacctcctgctgtgtggaaataccgggcttattcttcagaccataggtgatattttcataggcgttcagattcggaaacagggcatagtcctgaaatacgatattgaagccgcgctcctccatggatactccggtgacatcctgtccgttgaataccacactcccgctgtcaatttctgtaatgcccagtatacaattcagcagggttgtttttccgcttccgctcggtcccagaatggaaacgatttccccggtttctatcgatagactgattccgttgagaatcgatgtctgatcatacgatttcttcagattattcagtgtcagcatacttcactctcctcatcgcgatggttttactcgcttgtgtccattatagaaaagtgaaaaaagattacaatagctttcatcaagtgttaacgccctttttaccattccttaacattttataaattatgtaaattctctgttatatttccttcttcgcctggcatatgttcacagaaaagcaatgaaaagagctgttatttaacgaattggtaaataacagctcttctatgttcataattcaatttcatagacagaaaaatgaatatttggcaggattcgtgtaaggaacggcttttaatttgaattttcctgtcatttttaatgcatggcggtatataaagcaaccagaatggtgatatgcaggggatagaaggtatagaagatccattttggcagggttcctttttttccgttataccgggataacagtagcaaagacaacgaagcgtagaggatatataggaaagtatacagcagatcatctgcctgcaggctttgtccctgtatgagaagagtgaaggcttccagtaggatgacccctcccagacgatacagacgatattgattgcttccgtaatagcagacaaaaattgccagaacaccaagggcaccgtagtctgtttgcaggacatatgcgagaagcatgcagagcaacaagggaagaagggagagcttttgaagcgcttgtctgcttcggaatgcattataggccagaatagcagcggctcccagaaaaagggtgaaaaaaatattcgttaaagcaaggtgtaaagtgagcggagcatccagcaaaatacaaatcatatactgaaagggaatttccgatatcagccccataatcagcaatcgaatcagataggcgctgcgattgcgggttttgcggcagccctccgctatgaaaaatgcaaaaatccagaaggaggcggcgccaagcatgccaatcagctgaattccccactgtattacctcctgtggcatggcggtatgagccagaaaaaaatccagtatatcaaaacagaaaatcttatatatatggtccagcagcatcagccccattgcaatcagcttcaaggacgcctgattcagtgttatattcttcatctgcattctcctgtcgatataatgttgtcattgtcgtttgcatcagctttgcccctgcttttctccataaatttacccaagctgtactattccattataatatacaaagcacacgatgccaatagctgtgatacctcacctccacaaaataagagacgctctgaaacagcgaaaacagctttcctgacaacagacacagcaacatctgctcaatgtctctgcgctctgccatatgtattgcaaaaaaagaaacaggtgtaggctaagcccgttcctgtttctcctgtttcatacgtgcgcgggttcaatccatgcacgtattttattccttttccgattccttacccgccatatcctgatacagctccatatccatcagctccagctgacggtcaaccatgatggcattggtcagtgacccggatacattcagcatggtacgcatcatatcaataatgggatcgattgccagaattggtgttatgaaagcaaaggatgctcctaggccaacaccggacaaaccgactgaggccgccatggtactggtacctgggataccggcaataccaatggagccgatggtaatgacaatgatggacatgatgatcaaactgatatcaatcggtgtaccgctggtatttgcgacatagacaatcaggagcgccggaaaaactcctgcacagccctgcataccggccgttgttccaaagctggatacaaagcttgcggttccctgtgacaccccgagcttctgtgtcagtgtgtcaatcgttgccggcagaactcccagagagctgcgggaggtaaaggcaagcagtaacagagaatagctttttttcaaatatgtgatcggattgaccttgaaaaaggaaatagcgagcagttgaatcatgagctgtatgatacatgcaatatacagaatcacgatgaactttccaacctccagaatactgttcagaccgcgctgtgcaatcgtatttgccaataatgccagcactgcatacggcattcccttaataatcgtcatggcaatactgatgataatcttgtgcagagcatcaatcagctcataaaacacctggatggtatcgggatactttttctgcatacggcgtgccgcaagcccggaaaatgcggagaagattaccagtccgacaacattgctgttgaccatggcttccacaggattggcaggtatcagattgcgcagagtcgtcacaaccggtacgacctccttcatctctccgtttgtgatggatgcggcacttccgctacctccaagctgaaagacgattcccagtgtcagaccgacaacagcggcaacggccaccatgcccatggtagtaagaatactgcgttttacaagcttgcgtacattttcacgctcatccatatgaaggataacatgaatgatggaaaccatgacaagcggaattaccagcatacggataaaatcaatgaagccgttaccgataagcgaataccacagtgtcgtttcattcacaaacggaatcttcatcgggtctgccgcaaaaccggataccgcctgcatggcaagtcccagtgcaagaccgagcacagtcgcaatcagcaccttgctggaaaagctgaattttttctttggaagcttatatactgcaaaagccagcagcagataggcgattagaaacacaatggttttccactcactaatcatcagaaactggcttagaaatacgtttttcataaaacccctcctcgttgtacctgactatcatatacaagcagctttattttttcaagtcatatgcttactgctcttttatgttatgaaccatatccaagtttttatacctgtttttttatcatatgctgtttaaaagccctcggtacaggcgaagacagcagcttgctttccttaacccacattttgcaggcatgaaaaggaaatgtgcatttttgagaacatctgcaaacagaaaaacgacctgccgatagcaagtcattttgtacttattcctttgtttttttcgtatccgcataggttacgtggaccagataaagtccttccgcctgtgccttataccggcacagatgcttatcctgtccatacagcatctgtttgacatccgcaacatccagacgatgcttgcctgcttcaatcagggtctgtgcgatcatacgcaccatatagcgcaaaaatccgttcccctcgaacacaaggcggacagcatgctcctcctgtacgatatccaaacgagtgatggttttgacctttgatttgcgcggatcaagcttgctgctggtgaagctcgtaaaatcatgggttcccagaaacactctggcacattcactcatacgtttcacatccagcaccttgcgatccttccccatataatgataataaaacggattgttcacatccgttgtaatcagataatcatagcgcttgcttaccgcatgaaagcgtgcgtggaagtcatcctccacaagacatacatcctgtatccggatatcgtgaggaagcagggaatttaaagcacgcctccagttctccggtgccagatccttagcggaatcaaaatgaaatacctgtccgagtgcatgcacatgggcatctgttcttccacttgccgtaatacggataaagttgccttcgattttttccatggctgcttcaatttcctgctgtatggaatgcgtattcgtctgccgctgccagcctccgtaggcagtgccgtcataactgagtgttaccttatatctaggcatacagcatcatagcaaccattgcagtgaaaaccagaacagatgcaataagcagaacataatctctgccttccatcttcagctgcttatagcgcgtccgcatacggttggggatatagcctcttgcctccatggcataggccagatcctcagcacgctggaatgcagatacaaacagcggtacaatcagagaaagaatcgccttcaccttttccatcaggcttccctcctccatatccacaccacgggacgcctgcgccttcatgatgcgctgtgtttcttcaatcagcgtcggaataaagcgcagtgcgatggaaatcatcatggcgatttcatgagcaggtacatgaatgacctgaaacggcttcagcaggtcttcgattcccagcgtcagctccagcggctttgtggtggcagtcagaattgtggtaatcataatcattaaggcaagacggataacgatatacagggtctgtgcaattgccccggtgtaaacagaaaatccgaatatggtaaacagaacatccccgtcacgaatgaccagcagattgatgatgagcagaaacgtcagcatgaacagcatcggcttcattgctctccataaaaaggacagctttaaacgtgccagcagtgcagttccgatgaccgcagccgcaataactccatagcccgcatagcctgccggtatgaaaatcgcaatcatcataatcagcatggcaccgattttggctctgggatccatatgatgaatgatggaatccagcggcagatattttccaagtgcgatattattcatgcttcttcacctcacaagcgacagccgcagccagcttgtccatgtccagcagagtacggtcgatggaaaagccgcggcgaatcagctcttcccgaagccgtatcacagccgggggattgatattcagctcctgcaggagctctacggtttcaaagaaggactgcacatcacagtgctttttgatgcttccatcctgaacaacgacaacctcttcacaatattgtaatacatgctccatatcatgggtcacgatcaaaacggttttcccgtatttcttattcatatccacaaacagctgcatcatatcactggcaccctgcggatccagtccggctgtcggctcatccagcaccagcacatccggattcatggcaagtattcctgcgatggcaattcttcgcttctgcccgccggataaatcaaatggggagcgctgcagatagctttcatccagaccgacgaccttcagcacctccttcgcacgctgagcggcttcctcagcactgacgccgaaattcttcggtccgaagctgatatccttttcaatggtttcttcaaacagctgatattccggaaactggaacaccagaccgaccagacggcgcagctccttcagattttttggcttgcttcccgccgtaattgttttatccagtatctgaacttcgccctcgctaggcagcagaagggcattcagatgctgtaccagagtagacttaccactaccggtttctccgataatggctgttacctttccttccggaatctccagatcaatcccctttaaggccgcataggaaaacggagaatccgcattataggtatgtgctactttttgaaatgtaatcggcatacttcatccaccaccttttccatcgttgtgcaatccttcatatccacaccgtgtgcacgcatggcctttgtgaatttcaaggcaaacggtatatccagctgaagcgcaatcagctctttttcttttcttaaaatatcgtcgggaagtcccttcataaccacatgtccaccatccatgacgatgacataatccgacttactgacctcttcgatatcatgtgttatggaaatgatcgttatattgctttccttatgaatttcctgaatcagctcgttaatttccgcttttccctgcggatccagcatactggtggattcatcaaaaataagaatctgcggagacatggcaagaacaccggcaatcgccacacgctgcttctgcccgccggacagcttggtcggttcactctgcatatattccgtcatttttaccttttgtgcaaaacgttcaataatcggctgcattttttccgtttccacctgatgattttccagaccaaacgcgatatcatccgcaacggtagcgccgataaactgattgtcaggattctgaaagacgattccgaccttatcgcgaatatcgtacagggtgtctatgctcagctcatcctgatccacataaatatgtccctgatccttatccagcagaccgatcaacagcttagcaatcgttgacttaccgcttccgttatgtccgataatggttgtatagcttccctcttcaatcgaaaaagaaacatgctccactgcatttgtttccttatcataagagaatgtcagatcctccacacgtattttttccatgttctcacctcaaaattatagcgtttttattatacaacgaatcgaaagtgaacacaataaatctactgtgtaaaacaaaactaacaacacaaaccatggattcttccttatatgtatgaggtttcttcaaagacatccttatgagaaacatccactttacagagaaaagtacgtacatgcaatcatagaaatgctaaaataacatatattagattttgtccagctatcacttgcatgttcccacatgaaatatacacgctgtatacaataaaatacaaaacatattatgcattttaaacgattgttccgtaatttttataagtatgaatttttccttgcaaaccagtaagtgaaatgaaaaatatttcaagatggatgataaagaacctgcacttagaaattaggcaatcattaaattcgatttaaatgtattcacaatatttattataaaaaggcgttttgattcggtcaaataaagcaaggcagacaaaataatctaacttgctcttcatcatatacttactttttaacctgaatttattctaaatccatttctatttggcatgttttacattctcataataatttaaatttattcttgtcaccctcatcatttaaacaggtatcctcattatcacctttgatttgaactattatcgcaataacctccgttctgctatactgccagtcaataccttcgctatagcatataaaattagttcagcagttttacgaacggacttactttaatagacaacacatctgacgacgatagtcttttctattatgcttcatgcatgattttcctataccatctaatgcaaacaataaaacaaagaatatcggagattggctgtgcgattataacacctttgataccaaaaaaataatttccaagcataatgataggaatgtagaataatccttgtctagcaacagaaacaaatagggatggctttaccaatccggatgattgaaagaatgtcgagaatatgaagataccgcctaatattggtgtagagatggttataatcatgagaaataattctccagaatgtattacctcttcattatctataaacatctgcatcaagactgccttcatgaggataaagattaatacaaaaaacatacctagacataaagatattatattggcggctttcattgtttctttaagtttatctttcttttttgctccaacacagtaccctatcaaaggctgtattccctgcccaagacctacagttagttgaattgggaacaaattaattttgctgactattcccatagctgcgacggcaacatttccatacagtacacagtagttattcaatataatatttgagaagcttaacagaatagtaactaaagaaccaggaatcccaatcgatataatttctttttggagtgacatagcaaatgatacatcgttaaaatgcaatgacaaatatacgtttctttgaacataatagatatataataatgaagttacaacatttgaaaaaacagttgcaatcgctgcccccttcactcccatatgaaaatataatataaagataggatctaaagcaatatttaataaagagccaatcaccaaaccatacattgctttttttgtttcaccaaccgaacgcaatgtaaacgcaaaagcattcgatatcattatagcaagcgtccccaatatgataataaatagataatcatgtgaataactccatgaattagtatcacaaccgatgatagaaagaatcggatttatgaatactatgcctaacactgtgaaaacaaagccgcaggcaagtaagatatagaatgtatatgcagaagcttttttcatttcatgctcatttttacttcccatcattctggatatataagaagcgctccctatcccaaacaaagcacctagagacattaataccaaaaacactggcatggttacagaaatagctgcaacttgattaacgtcatttacctgtccaataaaataggtgtctgccatattatacaaaatagtacccagttgcccaatcattgttggaagtgctaaagcgagaattattttccatacggaattttcttccaatttatcgatattcatatacctactctcctccttttataattttgtaaaggattttcgcctttatatgtttacagtctatagatatgatgccatgttcatataaaatcatttatggtcaccgcctatttatcttgtataaaaagatatgctaagcatatcttttttgttaaagtgtatatgtttctattgtattactaataaaatttgactttagtttctccttgtatttcagaaatacatgtccatcatactgttcataaacatacttagattcccaaacttcaacattcactataacatcttcataatctgctgaagtaaggacataagtgtctttgcatccagctacctctttcatttcctctgcgaataattgcgaatctctcatatactcagttttctttgactgatttactttattttttacaagaacaatgtacatgcactctccccctctaactcttttccattgctttcaattactttctggtaccagtagaagctgtcttttcgataccgtttcaatccgtcttcataatccacatagataaatccatatcgtttatctctatcccctgaagcactataaagatctatacatccccaaggcaaatagcccagacactctacgttatctttatctacagcatctataattgcctgaatatgctgttttaggtaagcaattcgataatcatcatgcacttttttatcttttgtcaggttatcatcttttacacctaatccattttcaacaatcatgagcggtaagttataacgatcataaagatcattcattaaaattctcagccccagaggatcaattgtccagccaaagcttgattgcttcagcttcggattccttaatgcctgatacatcatttgtaatgtttcagcattttcattgatagcattactttcttttcctacacaaacagaatagtagtaactaaatgaaataaaatcgattttggctttttcatctttgaataaagcttcttcatgacgatatccgtgccagccatctttttcaaattgctttatgttttttgaagtatattcacctttgcataataaatctaaataatcataggtcaactcttgattatgttgctgggctagaaatacatcttccggatcactggttaggggatatgcaagtgaactcgctatcatacatcctatttttgcatgaggaagtatttcatgacagcgctttactgcataaaaatgtgcaatattcgtattatgatagattgtatacgaaaactccttatatcccactgtttccggtgtcatctttttccctattccaaatgttggcatttttaaagtcatattattttcatttaaagtcagccaatagctaacatagcagccgaattcctggaaacatgtatccacatactgtttgaatgcgtgtactgtttcaataccataccatccattataacgatccaccaaggattgtggcatatcccaatgatacaatgttacaacaggctcaatgccagacttctttaacaatttaaaaactcttttataaaaatccacacctttttgattcagactgccatccccatccggatataatctcgtccatgcaatcgacatacggaaagcacgaaagcccatttctgccagtagtttaatatcctcctcataatggtgatagaaatctgatgtaatagaataatctcttactttatttgcccccatccatgcttcgaatgattgatctacattatgcttcgaattctctgtaatgacgtcatatatggattttcctttgccgtcctcaaatgcacctccttcaaattggaaggaggaagtagatcctccccatagaaattcttcgttcatataagcctcctctatagtaacgttatcatggtttctccacgtttcacttgatctttatcacattctaatacttctaaatattcttgtgaatttgtaatgataataggtgtcacaatatcgtactctaatttttttatttcctcgatgtcaaattcaagaagttcatctccaatttttattctctgatcaggttttacgtaggttgtaaaatatttgccttctaactgtaccgtatcgattccaacatgtatcatgatttctgcgccatcatcggataacaaaccaattgcatgctttgtagggaatatggttttgactattccctttacaggagaatataagataccttcctctggaagcatcgcgattccttttcccatagcttcacttgcgaaagttgagtcatccacttctgttagttttacgattgctccgttacagggtgctttgatttctatttttttattatcttctttaatcgcattttttatttcaggttctatggtttcatccttcttactcaatacttttgtcaacacaaacgcacttataaagctaaccacaataacgacaccggcatagacaacgcccataattgatccatcaccaatattagcaggcaatcctaccaagctagcggatgcaatagcatagtatttcacacctaataagccagctaagatcccaccaatgccactcgcgacaatagtggcataaaacggtgtttttcttggtaaattgattccatacattgctggttctgaaatgccaagtaatgcagatatggtcgcagcatttgcttctgcttttacatctttattcttagactgcatacctactgcgaaagcagcacctgccattgcgatattttccgccagcatcgctggcacaatgagcgcttcagaaccattcattgccaatgtggttacgataacaggaaaagcaaaggaatgcgtaccggtagcaatcatgattggcgttaacgccgcaataataccaacagccaaaaatccaagattatctccaagatattgaacaaattcagataaataatcagctaaataagcaccagcaggtccaataacaataagcatgataggaaccacaatcatagtcgataacataggaacactaaaagcacggatgacctgtggacagattttattgaagaatttctctacgtaagataatagccacacactaagaataatgggcagaatcgtacttgaatatgttacattcttaattgcgataccaaagaaattcaattgttccaatcccagtgcttcaaaattattcaattgcggatgtaataatattccacccagcaacatggataagaatggattcgctcctaatttttgtgaagcggtgtatgcgacataaatgggcaagaagtagaaaccagcttcttttattagattccaaacataataagtaggactggtgtctggtaatatacctatcagattcaaaaccgtaaggactgcaccaaccatacctgccgccattaggatcaggacgattggtgtaaatattcctgagattacttcaaagaatttatcaactatttttttcttttcttttgagttatcattttcctgcttcgtaaaagtgcctaactgattcagttcatgaaatacatcaataacatccggaccgatacaaacctgatactgtccatttttaataattacatcaattacaccttttaactctttaatggacttcgtatctgctttatcaatgtcttttaatgtaaatcgcaaccttgttgcacaatgcattacaaatgttatgttgtcttttccaccaacatactgaagaattttctttgctaaatctgcataatcttttttcatctttttttccacctttcgtttatttagatttgagaatgtagtaaacgatggcggtcttgcctacttaaagtcacaatccgattgccctttgtacgttatcttaaaattttatcccttccttcccatataaaaatgctagatgttgtttacaactctttctatatgcagcacgagatacatcttttcttcatcgctgatctctgcatcatatgtcttcaaaaaatacttttcaattttttctacacataaatacgattgaaaatactttttacaaataatagaaaataattcatcgctttgctctatcttatttagaagctgtttatgtttgactctttgtataaaaaacttcaaatgtgtgacaaacctaagatagttcatggagtcttcattaatctgtatgtcaaaatgatacgatacaagcttacagattgctttcatgtctttcatttcattcttaatttcttccatactgcaggaagatgaggtattcacgatatgcattgcgataaagccagcttcaggttgcatcaaatgacagttcaaccgatcattaatcatcgtgattgcttcactgcctatctgatattctaccggataataatgttcaattacccaaatcattttattacgaatctgctgcccctcttttgaacgctctacagcataatgaatatggtctgttagtaataagtataaactttcatctagttttttctcaagtttttcctccgccatcaaaataatttcttctgttagcttgatatattccatagggatatccgagataagttcatagaatttcgacttgttttcagatttttttaaagaaaatattttatctacactgcataaagggatttcatcatcaatttttctcttaaatgcaataccagatccaagcagaatgacttcattttcattttcgtcaagtgagactacagcattattatttaatattctttttattctcatatctattctcctatcctccttaaaaaaacaagcaaaacctaaaagaaatctctttttcttttggtcttgcctacttaaagtcacaatcctttgtcatatacattgtattctatgtattttaaaatgtcaatatattttatttattaaatatacttttttcaaaccatttacttatctattatgatataatatagatatctatcttatggaggttcatatgaataaagatatacaaatacttacatctgagcacaatggtctaatagggaacctgattcatgaattagataaaaaaacacttactgtttataataccgcattgaaagaatttaacataacgtttcaacaggcaatgattattttattcatatacgtgagcaaagaagaaatatatcaaaaagacattgagaaacaaatgggattgacaaatccgtctgtaaccgctttgatgcggaacatgataagtaaagattttgtgtatagaatacaaagtataaaggatgcgagatattttcatttgcatttaacaccaaaaagtctttcgatggttgatgaaatagccagtaagattataaaaactaataagattttattagctccattatcaaaggaagaggtagtcactttacaaaggttattgtgtaaactattataatggcactatttctttttagtttatccttgttttagtgaccatgagattcgtattcagaagaacgctcatctttgaaacaaaaagaggcagaaattagcagggagttatataattttcaatctcgattttctatccaaaatgacataacacaagatgaatttcatacttttgaaaataacagctaatataaacctaaatataaataaatattttatttcattttcatgtttaatactgtcattcttgtataacgctgagcagttatgcttccactaaaaaacgacctgagctatgcttgcactgataacccttactctgtcctgtgaatcataaagacctatcaagattaagtgggtatatcccaatatcataaacatgcaatttatatggaataccaacaaaaaaagagctgtagtacctactagccagtttttcacgactattctctacaactccttatttctataaaatgtatactgttatatcacttcttgattgcgtcaatcggacgctggcgtgcaattctggtaaccggaaggatgcaggcaataaaggttacaaccgcaacgatcaccagcatcagcagcggctgacgcagcgtgatgatgaccggtgaaatcagaacaccgatttcatccttggcaaaattattggttatcagcgttaccagctgcaagcctatcatggtaattacataggagattgccgccagcatgacgccctcccagataaagattttcaaaacatctgtgcttcttgcgccgatggcacgcagaataccgatatcctttttacgataggaaatcgacacaatgataaaattcatcatcagcactgccgcaaagatgaacagtgcgatgcttgcatagaagaataccttggtagcgaagctcgcaaaatccttgatgcttttaacatcctgtgtagctaccgtgttggcatacagattgttgttgatctcatatttttcaagaaacggcttcaatgtggtatcatcaaagctgctcagcagctcactgacatacagcgtatccggaatgtaaggggcgatcagttccttattgacaatgttatcattgatctgataaacatcctccatactgaaagttccctccggcatcaatataccggcaatccgcacctgctgcttcaaaagctcaccgctgtttccaaagccctcatccacatgcagctccacatttcttccaatcagccgctttgcatgatcctgcaaagtcttgcgaatctcttctgtggatttctttaccatggcatcactatagaagctctctgattttcccagaataaacatcagcatatccggtgaaagcaggatttcatctttttttacgctctttgtggaaaccattcctgttccatcataataggaaaccgcctgcgcaggataggccagtgaggacatgcccttatcctcatcattgacccgcagaaatagattatgcctgctgctgtccagaacggttcccttctgctgcttcactgtatttacaaagccctctttcacatacagcttattactgcttatatttgctatatttcggaattcacgaacgagcttgtaggtttcactgtcgatattatttgcactgaccttcttcagggattcatatttgctggtatccttacttacaatcccgctgatgcgcatccatgtatcaccgattggcagctttacgttttgcaagatatcatcatatgatttcggaaattgcagctttcctttttcatctgcgattccctgtgtaaggatgatatccgccagataggaggaaatcgccatttccttgtaatcctttggaaaccttcccttgatatccttgaagcccagaacatcaaagctgctcatttctgtcagcttatactgttcgacagcagcggaatatgctgtactgtccagctcctcaattcccaaatcgcccagacgcagcggcatcgtatcccaggaatagacctttgcgaacttctgctgcggattctcctttaaaacagtttttatatctgcatcctttatctgcgtatccattccggtataaataacgtttccctgatcatcgatatactgataacgaacacccgcatactgctcctgtaattcctcagccgccttatactgcgcattgacagagctgaagtttccaacggcatccgaaagagccagcagcagcagggcaaagctggtcaacagaatggtgaataccattcggatcttcttatgccccagacaggaaaagccaagacggaagctatccttaaacggcagatgggaatgaattgcttcaaacacctcggcgtgttcttcaacatcaggcgcgctatcagcttccacaacaccatccttaaattcaatgattcgatccgcataggcttgtgcagattcccggtcatgactgacaacgatcaccagcttttctctgctcaattccttcagagtatcgaaaatctctttccctgtcgcagaatccaaagccccggtcggctcatccgccatcaaaatttccggttccttaatcaaggcacgggcaatcgcaacacgctgcttctgtccgcctgataattcattcggatatcttgccgcatagccgctcagccccagtcgcttcagcatttcttcgatgtccgcatgggatgcttccttctgctgcagctgcagcgccatggcgatgttcttctcaatggtatactcctccatcagattaaattcctgaaagataaaccccacatacgtattgcggtaggaatcatagtccgattgcttgaaatccgcagagcttttcccattgatgatgatttcccctgcatccgcctgatccagtcctccgatgatatttagcagggtggatttccctgaccctgattttcctaaaacaaacaccatcccgcgctgtggaaagcgcagattgatatcctttagagcctcggttttcactccctttgctgttttatacgtttttgctatatgtttcagctccagcattgtattctcctccctgtacatgtcgcaaactgtactactgtatctattacactaatacactatatgaaacagcgggatttgtcaatgtattcctagaaatgtgaccattttgtaaggttcaggatagcaacgcatacagtatggtgtatgtattctgatttaaacagaaaagacgtagaacattgcttatctatcgtgttaccctctacgatgtcatcttttcatagaatgaaaataaaaaaggatttatcagtcagcagctatgaaacgctttcatcctgcttttgataaatcctattgctgttatagatgctgtgcagctctgtaaaccagacctgatgaacgctgatgcgtgcttgccctgatgatatcacttatgaaattcagacatgctttgatcaaattgattcgcatcctttttccgatacagccttcgcgatacgataaaccccttgtgacttttgaactgcttgtttaaaaaatcataataagctcccggagatataataccgctgaggtcaaacaaattcaagccgatagagctcagcaggtttccaagaaaaaaaacacagttgctcgataccacaaaaaaggttttcagctttccttctcgtatcttataaaatctggcttccggtgatgtacgggtaacacggctcagatagtcatcacaagcccccttgcagggaagtcccttttgctttagctgctcgtcacactcaaaatcacaaaaggtttcaaatacctccagaatgcggtcattcagcctttttttctgttcctcattcagggatacaccaaaaccgatcagtgtcttattctcattctccagacagttacgaatataggtatcctttggtgcgataatgacgacaccatcccccagtgtaccgaataaatgccggttatgcggatcataacagccataggatatgaccaatccacgatatacgacatccgcatgtccaaacatagcgggtccacttggcgctaaatgtatcagtacctccatatcaacgggaatatcctcttttatggcatcaaagcgttccttgatttcatcctctttatccttgttcaaaagggtactcatcagatgtggaggaataacggcagacaataccggaggtaccgagagctgaattttctgatccagcttatccccgctaccgctcggaagaatttcccgtatcagatcaagcagggtgtttcctccgtaaataaggaaataggcacccagaaaaaagctgattacatcctcatgtgcgcccggatttacaatcagaaaaaaggctatgatcaaatcgccgcatagaaaaatcaccttcataaacggaatcggcagccgatccttgattttgatataaaagacgatgattttgataatggcatgcagcagaatccagcagccgatcaaacgcggaaagatggcgaaaaaggtttccgggatcgccagtgatatgataatcgcaatcagccacacgatgatatccagaaactgtccgcccttgtgcttcagcttgcggtaattcagaatcatattgaaaatacgaataacaccggcgacggatataccgataacaagcgttgtatacagccagttccagacagcaagagaatcgaagataaaggaaaaaccgagcacacagaaaaacagcccggtcgcaaacatagtaaaataattaaaatttttcttcagcatgccctcatctccctacttcctataattatagcgaaaagaaaaaattccgcaatctatttttctggataatacaaagaaagaaccatagcggacatgtgttggatacatattcatgcagcataaaaaaatatacatacgttatatgcctggtctgtgcttcaatgcatattccctgttctcctgaaattggtaccgcctgtccacgttagaccgtttccaagcttacgtaatactcaaatgcttcccctttcagaaatacagacagtatgatcaacaggctgcttttgcacgcattgtcgaaatggatatgaatttctgtttccccaagtatgaaatcagaatcaggtatgcctttaatatgtgagcctttttcaccacaagatccatcagccagtttagagaaaaacgtagttatgttatcctgcaacgtctagccacagccttgtaatggataacgcagactgctgcaggagtcagatagaaattatttttgtctggatccaaagtcattggaatggataccgtggctcctattggaaccagggagtgccaatagccttaaccatcatttcaaatggaaggttttcggcgccagacgatatactaggagaagcgcaatcgggatatatagaagtgtagcagccaaaacaccgctgacaaacaacagacttccctccagctgcatgcagaaatagcaaaaaagatacacaagaccgttgaggatggacataaacgggtttttcatatcaaactgctcattatacggctgaaagatatagtagacaaacagataatgaacactgaaaaacacagccagacaaagcaaagcaaaatcaaacagaagaagcgtggagagagtatagggcaatccaacaagcacaacggtgatattcatgtacaggcaaagcaccatgatcagcaggagattatagaagcagagcttttttaagcgaagtcggaaatttaccagcaccgcctccctgctacgataatagctgtaatgcagcagcgatacatcacagttcataaacatcgccttacagacacgctgtgagatgctgaggatataggaaaggaatacaaatggcggaagcagctccagaatatccttcgtgagtttcatatcatccttcagcacgatcagcaaacatgtccctgcaagccagagtgctgtcatgacagccagacgaaaccttaccggcttataaatcagatgcttatgacggcggaagaatagttcatttaaaagggcatagcccgtattctttgttcgatattgcagctcctcactcgtatagctcttttcatccaccgctacctccatctgcttcatctggctgctgtccagcttcagtatttcataattctccacaagcagacatgtcagcagctcactgtaagcatgatagctgctttcaaaacgcaaatagggaatgatggctgctgcacacacaagtgcaaagatgcagaacagccatggagtaaagctgaaatccacattcagccagtataatgcatacagcaagatcaaggagccaagtggaatgaggagcttccatgtattcgcttgcaaataaaagctgtttttcctttgaaagcgccgcatctgcagcatgtccatacactgatgggagcccagatagccgaatccggccataaatgcataccagaagggaaacgaaaacataaaggacagaagcaggcacgccaggaagagtccgatcgcattcatgctatagctgtaccagctgcgggagcacagacagcgtctggctgccatatgcatctggcggctgagaataaaggtttcatcgtccgctgtgagaagcttgctgttgcttatgcttcctgccacaagacttaacagtacaaagccaaacagaaatccatttctaatctgcacatcattcgcacccttttgcagattgatcagcggcacagcaatcaccacaaacagatacagcagattcttcaataggttcatcaggatatccacaaggaaggagaagacactcagcactccctttagatttacagccgcataacaggattccttcaaaagcctgccaatcagagggagttttttaaagtaatagaaaaatccgttcacctttctggtcatccgaatccgaaacagcagcagaatatcactcagcatgctttacttcctcctgcagcagtgaaacgatgcgatcctcaaaatcattttgttgcagcagatcatgaccgagctgttccagtaccccgttatgcaatagcacgatctcatcacagagatctcttgccagctgcagaatatgggtggagaatatgagaatgtgttcctccttcatttccagcagcaaatgcttcatttcatttgccacaacaacatcaaaggatgtcagcggttcatccagtaaaatgatcttcggccgtgagatcagaaatcccagcatctgcagcttgttcttcataccgtgactgtaccccttaatcagacgatgccggtcctccgctacgatgcgcatcagatcaaaataggaatctatggtcttggcagaatcaatttcctttgcatgaatatccatataaaagcggatatattcaaaaccagtcataaattcaggcagaatcgggctggaatatgcatagccgatatctctgtcctctaccttacgcaattctccgtgctcctcaatcagaacatcaccctcacagggtatctcgtgagaaatgcagttaaacagcgtcgttttaccacttccgttcctccccagcaggccataaatcttcccctgttcaaaaacagcgctgccccctttcagcactactttatcgtcataggtcttctttacattttgtatatgcagcttcataggtatcctcccggttgtccttctctaatgcagacactgtatccgtgtttgaccgcttattttaccggctatttgatggtcatgcgacagcctacggcatctgtaagttcaggatactcgtacgaaaatcatttgtcaattaaaatcaaggatttgcgtcatgatattgtaatcctgcaggacactgcctataatgaagatagaagaacaggaggctattgtatgcgcaatcatgaggttacacagcgtcatcctctgctggatgagcatggcagtttgaaagaggcaggctggtcccgttcattgctgcaggaatatcgcagagaggatattaaagcaaaacgctggagaatcaaggaatgggattattatctgatactgaacgatttttacggtgtcgccttcacaatctccgatgacggttatatcggactgcaatccgtttctcttcttgattttaagaagggctgggagcataccgaaaccatactgaacgcatttccaatgggtaagctgaagctgccgaccagctcggaaagcggctcctgccgatacagggataagcgactcgatatggaatttcaggtcatgaagggcaaacgcattcttcgctgtgattttcggaacttctatgaaggaaaaccattccattgtgaaatcacgctgcatcagccggatatggacagtatggtaattgcgacaccgtggaaagaaaaaaagaccgcattttactacaatcagaaaatcaattgcatgcgtgctgagggaaatgtcagctttgacggtaacacaatacactttgatccacaggattccttcggaacactggattgggggcgtggggtatggacctatgacaacacctggtactggggaaacggaaacggccttgtggaaggaaaaccgtttggcttcaatgtcggctacggctttggtgatacgacagcggccagtgaaaatctactgctgtatgatggtgttgcacacaagctggaggatgttaccttccacataccgccggacagctatctcaagccttggcgtattacatccagcgacgcacgctttgaaatgtcctttcgaccgattcttgatcgttgtgcgaaaacaagtgcgctcatcattgtaacggatcagcatcaggttttcggctacctcagtggaacggccgtattggacgatggaagcatattgaagctagaggatatgctttgcttttttgaaaaggttcacaaccgctattaaatcatatcattattttcaattacctatgtgatatgattacatccatagggcttacgtatcatctgttctaaaagccgaataggtcatttctactttaacgggagataagaaaatgaaagcaaaaataaggttgtcatttatattcgcctgcgcaatcattttatccgcatgtgaattcagcaaggatacggttgatccaaaggattatatgaactataattataaaaatcacgagcaattaaatgttatagaagataagcaaagcttactatatttactaaaacaaggggacacctatcatctgttgatttttaagaaggatggttcatcctattcctatgaaggcggcagagaatctgatacaccttttggctatatgaaggttggaacgcccgataatatccatatcgttatctttatcgataacagtatcgtgaaagcagagcgctatgaatttgatttgcgtgcttccaagaatgataaagataagctcaccatatcactggatggattatcaaatctggatacctatcttatcaaaagctatgacttccttccgccttattcaagtatttcacaattacgtttttacgataagcatggaaaacgcatagacgaaacagtgttaattgattgaaaaaaaaacccggtgcataaaactggggggtttttctttacgaaaaaaatctctatagtgctatgagcattcagcgaataaaagcaagtgtttcaaagctgagaaaaagacgccgcagtatgtgacgtctttctatttgtatggcttaataaataaccttactgctccatccctgatatttaccatgatgcagcttcgcttcgccggcaatatacaggatatttcccatcagcttgacatcatcaatcggtgtgatatgcaatacaatcagctccaggtcttcatcccctcttgtgatgacgaagcccttattgataacctcatttttaaagctgtccatatcctcggctgtctggaataccacgctgtgctgaaccggacgctcattttcatgtacatcaccctcctgcagcatgtcatccatcaatttctttgcctgctccttcagagctgccgtttcactcttcaggagagacggaaaatccgtatcaaattcctctgcagcatcctgaacgatatcctttgcttccgctgcctgattcttcacagcatccgcaaaatcctcagctgcttcttttccttcttcaaaagcatcctttgcaagatctttcaaatcctctgcagcatccgcagcttcttttttcacagtctccatacaggaagcgggatcactgatcggaccttcttcaatttcgtcatccatatccatttcattcaggtcatcctcatcctcaagaagtccctgatcaagatcaacgatctgtttttcctcatcctttttcagcttgtaggcaaccagtgccgcagctccggcaattaccgccagtgcaggtattatctttttcatagtatcaccactttcttgtttctattgtatcacaaaacatgcgaaatgatacatgaaatagcttaatttcaggaatagtttcattccttactgcaccggctacgccttttctttccgatctatactcacactttttttctgctgattcccacaccgtctccaaaatcataaaattgtgtatcataatcctcacgctgcttcagatactcgacaaaatttccgattttacgtaccagactacgcagattgcggcttttaatgttttccggatgctctaccagaccatggaatttcagattatccgttattacatatccgccctttttcagcaatggctcatagcgctcgaaaaacttagtgtactgtgccttggccgcatcgatgaacagcatatcaaagcttccctcaacgactgtctccagtgcatcaccaaacagcagtgtgatccggtcctgcaagccgcttctttttacatactccacagcctgatcatagcgatccttatcccgttcaatcgtggtgatctgtatatccatatccagcattgccatacggattgccgaatagccgatggcacttccgatttccagcacatgcttcagattatgctccttcagaaaggagcacataaaatcaatgccctccttctgcataatcggcacatcatgttcgtgcgcatacatctccatttcttctatcagcgtcatttcgtatcccctttttctataacaggtatttctgtaatcaccttttttgttcgtgcatacagatcattcaggcgaaccttctgtccgtccacaccatttaatccatgctgttccgccagctcctcgctgtaatcactcagcttatatactgtgaaattctttctcgtattcataatatccgcagcatctccagtataatgtgtaatcagtggttcccatttcacattctggatggaaatttcactgctttttgcgtcttttacaaaatcgaaacggatcataccgccaagaacgttatttacatccagcattccattcagaaaattgccaagtgagtaaatgaccagcgtcttatttccatccttaccatccatccatgttaccggctgaatcacatgcggatgctcaccgacaacaacatcaacacccaaatccgcaaacagctttgcatacttcttttgaaactccgtaggggctgaaacattttcatcaccccaatgcgcagaaacaatcacaacgtcgctgagctgttttgccttcttcacatcctcgcgaatccggtcctcatcgaaataagcaacactgtagggattgggtggttcaattccgtttgttccataggtataggcaagaaaggaaaatgtgattcccttgcgtttgattgtacgtatcgtatcccgatccttctgggaggtataggttccagctgtaataatgcccttctgttttgcccagatttcatgagaataatcaattccctcctgatatttatccagacagtgattgtttgccgtattcacgatatcaaagccggtatccgcaacatttttagcgatatccgcaggcgtgttgaatgtcggatatccactgataccaagcgcatctccgccaacaatggattcctgatcgatataagcaagatccgctttctgaatatccttctttacatgcgtatacatttccgtaaaatcatattttccatcattcatctcaccggcagcagcatccgcctgcttatatatcatttcatgaatcaaattatctccgactccgacaaaggataccgttgtattttcatttttcggatcctctttcggtgtttctttttccttattctctgatgtactgcatgcacacagcagcagactcagcatcaaaaccataagctttttcatttctgcacatcctttctggcaatatattcatccagtgtaagcccctgcttcacaatttccttagcaatatcctttccgacatagcgcagatgccaggattcatactgataaccggtcacatccaccttatcctcagggtatcgcaggatgaagccatagtctgcgatatgtttaagcagccagtcataatgctctgagttttcaatttcattgaaattttcattgttaatggtcacatccacggcaagggcgctgttatgctcactctgtcccgggcgggcatagtatttatccgcatactcctttccctgactctgctcataataatcatacagatttttctgatatgcaaagctgcgatagcttgcaattgccttgatattgatttgcttttcttttcctgccttcaccagctcggaaaatgcattcgcaacctccttgcgtagatactgaggctcgctctgacaggaaaaatcttctccaattacacaggcattcggagtctttaccaaattcttaggctcataatcatccggcagccggtgatatttattaaccagcagtgctacatcatcagtatccctgattatatcaacgttggtgaaatatggctgatccaagccgatattaactttcgtaacaatgtcctgtactgccctttttccgtcatcgtatgcaatatagcgctcggttaactccttgtggtagtatggaagctttaaaaactcgctgatgcgcttcgcatcgtaatcctttttcacaaaggcagttgcctgatccagattcttatctgttgtgatggcacagtagacacttcccttgtcctttacaagcttgtcgcctgcctgcttcacagccgcaagattatcacagctttttgtatcctctaccccatactgttttagggcgtcctcttcctcgttggaattgcagccggcaagcagaaaccctgccgtcataagtatcatcagttgttttctcatatgtacatccctcgctccaccatattataacagtttctgtttattcgtacagtgacatccgcaaaaagcaggtgaatcttccctgtttcttaatattatatatgggaagcttgctgtttttcctcaataatacggctgtcttatgaagcggcggacataatggaaaaaagcgaactctatacaggaatgtagagttcacttgttttctatgcttatacatcgcccagatattcctccagcgtgatcccctgtgacataatccgggatgcgatttctttcccaacgtagcgaacatgccatggctcgtattgatagcctgtaatgctttccttacctgccggatagcgcagaataaagccatagtctgcacaatgggcattcagccatctcccacccggcgtattgccatacccgttatccaaggcaccgatgtcaaaggcaagaccgctttgatgctccgaatgtcccggtcttgctgaataggtatcagcaagctcctgtccatcctgtgcgacatagctgttatacaaggaagcctgatatgcataggaacgatagccgctgatcagcggcatggaataaccagcagcctcagctccggcctgaagctgctgcagagctgcgtaagcattggaatccatccctccgtaattctgtggcagtgcatgctttttattcaccagaagcactccgttgacgtaatacggctcgacagatgcagcttcggaaccttctgtctgtgatgatgacgcttcatcagaagaagaaggatttttttccttcagctccggctctgtttttttctctaccgttaccgtaaactttttttctgcactgtttccatttaaatcctgtgcatgtatggtgatggtgtagctccccgcctccaacacattcagtttgctgtcaatccaatagcttccggctgcttttttgtttgctttcttcaagggtccgtcaatcggatcacgaacgctttttatattatctgcgacatcatacttctgcccatattccagtgtaatatgattctccttcagctttattgtcggttttcttgtatcctttacttcaaccgtatacggtatttttttcgtctgcccttcataggtcaatacataggtgattgtctgactacctgttttctttgtattaacgttcgggtaggttttcacttcaccaaatgaatgctttacaaaggagcggctgtctatcttttccccatattccagaatctggcgatccttttggaatgttatctccatctttgcataatcctgttcctttttttaattttgtggccagatatagccaacaacggcggaagctgcaagtattatcgcaataccggcaatgagaacttttttcttcattcgcatgagctacccacatcctttacaacactataatactacaatgcaggtaaaaagaatacaggtaacctttttttcaatataaaaagacactgctgaatcgtatgttaacgaaaccacagatctgtattcaatttctttttttccatcaaatacatgatatgtctatcgcataagattatttgtttaatgcgaatgcatgaatcctccatattcataaatttaatacgggaggaattctattatcgcctgcacaacaacagttgtgatcatacaggagccctcgtcaaacaattccagtttaacagctgatctgcctttgtcactggtcctaaaaaaggatgtctaaattaccgtagggataaaaaaactgcagcgctatggatttgcgttgcagttctcatgttatttatttaactaattcaatgattgccataggtgctgcgtctccgcgacgtactcttgtcttaacaacacgagtatatccacccttacggtctgcataagcaggaccgatttcttcaaacagcttctgcagagcagtctgtcctgtttcttcattgacaacaacatcacgtacaaagcttgcagcctgacgacgagcgtgcaggtctccacgttttgccagtgtgatcagttcatcaacaacggaacgaagttcctttgctttcatttcagtagtttcaatctgaccgtaagcgatcacggatgtcgccatgttacgtaataaagctttacggtggtcagctttacgtcctaatttacgattccacattggtccattaacctcccttgcgaatatttattcgtatgacttgaaactcagtcccaaatcatagatcttatctttaacttcctttaatgatttcttacccaggtttcttacacgcatcatttcatcctctgttctctgcgtcagttcctccacagtctggattcctgcacgcttcaaacagttataggaacgtacggataagtcaaggtcttcaatcatcatgacaagtcccttattctgtacctcaccctgtgcttccttcatcacggattccatatcgtttactgcttcgtgaacattcgtcagcagctccagatggtcgatcagaattttgctggcaagtgctacggcttctgcaggactcagtgaagagtctgtccagatttccagagcaaccttgtcatagtgagcatcctgtccaacacgagtcggctccacattataggataccttttcgattggtgtataaattgaatctgtgtaaatgattcccagaggctgatttggtgtctggtacagctgcttgtttgtgtcagcactcacgtacccgcgaccaatacgagcctgcagttccatttccagcattccgccctcttccagtgtacagatgtgcaagtccttgcttattacctccacaccttccgggcaaatgatatcagcaccggttactgcgcctggaccctgttttgagatacgcagggtataaatttcatcatcctgaatactcatcacaagggttttgatatttaaaatgattgccgttacgtcctctacaattccaggaattgaagtgaactcgtggtaaacaccatcaactttaattgaaaatacggcagctcccggtaaagaggagagcaaaacacgtcttagtgcatttccaatggttgtaccaaaacctctttccaaaggttcaaacacaaacttcccgtaatgttgagattcatcatattcttttacttcaaaatgtgcacgttcgaatttttgcatagtttacctcctcaattacagttaatcattaaccacgtggtcgtttaggtggacgacaaccgttgtgcgggatcggtgtcacatcgttgatcaatgtgatttccagtcctgctacctgcagagctcttacagctgcttcacgtcctggtcccggaccctttacgctaactgcaattactttcataccattctctattgctgcttttcctgcagcttctccagccatctgtgctgcgaaaggagtggatttacgagatcccttgaatcctaaagcaccagcactagaccatgctacagcatttccgttttcatcagtaatagtaacgatggtattgttaaatgttgagtggacatgtgcaactccacgagcaatattcttgcgtgccttacgtttaccacgtgagttcgcttttacgttctttgccattatttacttcctcctatcgtcctatttctttttgtttgctactgtacgaactggacctttacgcgtacgagcatttgtctttgtacgctgtccgcgtactggtaatcctcttctgtgacggattccacggtagcatccgatttccattaaacgcttgatgtttaactgaacctcacgacgcaggtcaccttcaacctttacaccatcgatttcgttacggattgcatttacctgatcttctgttaagtcttttacacggatatcttcgctgattccagttttagccagaattttttctgatgtggagcgaccgataccgtaaatatacgttaatgatactactacgcgcttatcgcgtggtaagtctacacctgcaatacgagccattacattacacctccgttagtttccctgtctctgtttgtgttttggattttcgcaaataaccatgacgcggcctttacgtttgataatgcggcacttatcgcatattggtttgacagatggtcttactttcatgcgttttcctccttaattcacgacttacttgtgtcggaatgttatacgcccacgtgttaaatcatacggtgaaatctctacggtaacacggtcccctggtaaaatgcgaatgtagtgcatgcggattttaccagaaacgtgagccagaatttcgtgtccgttggccagtttcaccttaaacattgcgtttggcagagtatctacgacaactccgtcaatttcaataacatcttgtttacccattatctggacgttcctccttattcagtgttgtgagtatttcatacccacggtttgtaatcacaatcgtgtgttcgaaatgagctgccttgctgccgtctctagtgacgacaccccagccatccttcaacattcttgtctgtggtttgcccgcgtgaaccatcggttccactgccagcgtcataccctcctgcaggaggatgccgcggcctgccgggccaaaatttggaactgtcggatcttcatggacagaagttccaataccatgtcctgcatagtctcttggaatcgaatacccgtgcgtaaacacatattctccgattgcatgagaaatatcagttaaatgattccccgctctggccatttttaaaccttcatacaaggattcttcactgacacgcatcagtcgctgatcttcctcgctgagcttgccaacgccataggtccaggcagagtctccatggtacccctgataacaggcaccgatatctactgaaacaatgtctccgtcgcataaaacggtatcgcctgggataccatgtactacgacagaatttatagaaatacaggctgctgccggaaagccgtacagacccttgaatgacggtgttgcaccgttttccagaatcacattttcaatgattctatccaattcctgcgtggtaattccgggctgcattgctgcacttgctgcacgatgtgcaagcgcaacaattatacccgcttttctcatctttgtcaactcctgatttgttttggctttcaccattcctatttctccagagctgtcagtgtatcattccatacgctgtcaatcggctgactcgcatcaattcttgtgacgattcccttactatcataatagtcaagcaccggagccgtctgtgaactgtactcttccagacgcactgttaagctttccacagtatcgtccttgcgctggaataattctccaccacatacatcgcaaacattatcggttttactcggctttgatttgatgtgatagatttctccacattccttgcaaatgcggcgtccggttacacgatctgccagcttttcaaagtcaatttcaagtgcgatgactttgtcaatggcaagctcgctgccttcagccagtgcatcgaatgctttggcctggtcaagtgttctcggatagccgtccagcaggaaaccgtttttcttgtcttccagcttttccagataactctttaccatattgttaacgacttcgtcgggaaccagcagtcctttatccatgaagcttttcgcctccatgccaagagctgttccctttccgatttcactgcggaagatatctcccgtggaaatgtggttaacgttaaacttctcgacgattttggcagacatcgtaccttttccggcaccaggtcctcccataatcaggatattcataggttcaccttctatcgttttatctctgcaggaatccgcggtaggatttctgtgtcaggcgtccctcgatctgttttaccgtttccattgccacaccgacaacgatgatgattccggttccaccaatacccattgactgtggaagattgatgcctggaatcagaggcagtgcatgcggcagaacagcgataaaggcaagcccgattgctcccagaaccgtgattctgcacaatactttgttaacatattctttggtctccgtacccggacggattcccgggatatacgtaccggattttccgaggttctctgcgattttttccggatccacctgcagcttcgtatagaagaaggtgaataacagtatcaaaaccacatagatcacaaggctgaccggagtctgcattcccatataggtttccagtgttttgacccagcttgctgctggccagaccattttgcagatctgcagcggcgcaaccatgatggcggatgcgaagatgacaggaattacgctggcggaattgattttcagcggcaggtaagtcatgtccttcttacgagtcgttacagtactggatgtatactgaatcggaatcttacgttctgctgtctgcatgaagacgacgaatacgataatcagcagataggacacaatataaagtccgaatgtcagaataccattgaaggttgcactgctgttgcttggatccaccagtgtctgccatgctgttgtaaactgatatggcagtctggagatgataccggcagcaatgatcatggaaacaccgtttccaattcccttcatgctgatacggtctccaatccacagaatgaacatgctgcctgctgttaacagagtcgcaacgtacaaaatagaagcccatccgcttccatttaccagcagtgttttatactgtgtggagaaactgtaaaccagtgtggatgcctggaaaaagcttaatacgactgccagatagcgtgtataacggtcaatctgcttctttccggttgctccgcccttagccagttcggtaagcgcaggaatgacatccatggataacagctgaataataatggaggcagtaatgtatggaccaacacccatcgcaaaaatggaaagctgctccagaccaccaccgcccagcatattaatcatcgcaaatagtgagctgtcctgcataccttttatcaattcggttacatctacgcccggtacagtgactgctgaaccgaagcgaaagacgaacaacatggcaagagtaaagaatattcggttacgaatatctttattcttgaacatgtctgcaaaggtcctaaacatgattagataacctctgcttttccgcctgcctgctcaatggtagcgattgctgatttagagaatttgtttgcttttacgctcagcctcttctccaattcaccttcgcccaggattttaataccatccagttctttctttactaatccacattcaatcaacagttccggagttacttccgtaccgtcttcaaacccgttcagggatgcaacgtttacgatagcatattccttgcgattgaagtttgtaaatccacgttttggtaaacgtctagcaagtggtgtctgaccaccttcaaaacctaaacgaacgcctccgccagatcttgctttctgtcctttgtgaccctttcctgctgttttaccatttccggagccatgaccgcgaccaacacggtagcttttctgtctagctccttcagtatatttcatttcatgtaatttcatgttctaatcctcctattaaccgcgaatttcttctggttttttaccacggagacgagcaacttcctcgatcgttttcagatctttcagggcagagatcgtagcacgaaccatgttgattggtgtacggcttcccagacacttggaaaggatatcgttgataccagccagctccaggactgcacgaacaggaccaccggcgataactccggtaccttcagaagcaggacgcaggaatacttctccagctccatatcttccagtgattgcatgaggaattgtagttcctacaacaggtactgtgaagacattcttcttagcatcttcgattgctttcttaattgcatcaggtacttcgttggctttacctgtaccaaagccgacgcggcccttcttgtcaccgataacaaccagagctgcaaagcggaaacgacgtccacccttgactacttttgttacacggttaatggtaactacgcgttcttcaaattctttttcagcatcgcgatttcttcttggtctacgttccattcgcataacctcctaaaatttcaagccagcaactcttgctgcttcggccaatgcctttacacgccctgtgtaaacatatccaccacggtcgaatacgacaccagtgatgttcttttcaattgcacgctttgcaatttctgttcctacagttttagcggcttcaacatttccaccgttttctaactttaattctacactacttgcagatgccagggttacaccgttaacatcatcaatgatctgcgcgtgaatgttgctgtttgaacggaaaacgttcaggcggggacattcaggagtaccgctgattttggtacgaacacgcacgtgacggcgcatacgctcgtcatttctagaaactttcttaagcattgttcaatttctcctttcccactatttcttacctgctgttttaccttccttacgacgaacatattcacctttatagcgaataccttttcctttgtaaggttctggttttctcacagcacgaatgtttgcagcgaattcaccaacgcgttgtttgtcaattcctgatactttgatatccgtagcagaagagcattctaccttcagaccgtcttctacagcgaactcaaccgggtgggagtacccaacgtttaaggtcagcttgcttccgcttacagcagcacggaaaccgatacctaccagttccagttcctttgtaaagccttcggacacaccttccaccatgtttgccagcaatgcacgggttgtaccatgcagctgtttcacatgcttttcgtcgttaggacgagttactgtcaatacattttcttctaccttgattcccaaagcagggttaaactgacgagttaaagttcccttggaacctttaacagtcacctcattcccggcagcgatggttacttcaacgccggcaggaatggtaatcgctttattaccgatacgtgacattttcttacctccgttaagctcttaccaaacgtaagcgatgacttcaccgccaacatgtttagctttcgcttctttatctgttatcacaccgtgggatgtagagatgattgcaattcccagtccgttcattacgcgaggaatggagtccacctttgcgtaaacacgtaaacctggttttgagattctcttcagcccgttgattactttttcgttgttaggaccatatttcagagtaactgtgatggttttcttaacatcaccatcgactgtatagtctgtgatgaatccttcattctttaaaatcttagcgatttcaactttttctttgtttgcaggaatttccactgtttcgtgacgagcctgaagcgcgttacgaactctggtaagcatatctgcaatcggatctgtcataatcatgactgtattcctcctatctgactaccaacttgcctttttcacacccgggatctgacctttgtaagccagctcacggaagcaaatacggcagagtttgtatttacgtaaaactgagtgaggacgtccacaacgctcacatctggtgtactcgcgcactttgtacttctgaggacgttttgatttattaaccattgctttttttgccatatacgtctaagtcctcctatttcttgaaaggcatgcccatttcttccagcagtgcctttgcttcttcgttcgtgttggctgtcgtaacaataacgatatccataccgcgaaccttgttgatcttatcgtaatcgatttccgggaagatcagctgttcctttacacccagagtgtagtttccacgaccgtcaaaggaagtggcactgacaccacggaagtcacgtacacgaggcagtgagatgttcatcagcttatccatgaaatcatacattttttcttttctcagagtaaccttacatccgatcggcattccttcacgaagtttgaagtttgcgatggacttcttagcttttgtgattaccggagcctgtccggtgatctgtgccagctcagcaactgcttcatccagcacttttgggtttgaaatagcttcaccgatacccatattgataacgattttatctacgtgaggtacttccatgactgatttgtagttgaatttcttcatcaggcttggtgttacgacctctttatatttctgttctaggcgattcatcctttagcctccctacttaacttcagcgccggtttttttgtagacgcgtaccttttctgtgttaccttttttgtcagtttttgtttcataaccgacacggcttgccttcttcgctttggaatcgtaagccattacgttggatacatggatcggagcttccttctcgatgattccgccatccggatttacctgtgtaggcttcagatgcttcttcaccaggttgacaccttccacgattactttgtcttccttagggaaaactttggttacttcaccaatagtgcccttgtaagcacctgtaataacctgaaccttatcaccttttttgattttcacaaagacacctccttacagtacttctggtgccaaagacacaattttcatgaagtccttgtcacgcagctcacgtgcaaccggtccgaaaatacgagttccacgcggtgtattgtcgtccttgatcaggacaaccgcattgtcatcaaatttgatgtatgttccgttgtcacggcgaacgccacgttttgtacgtacgattacacccttgacaacgtcacctttttttacagttccaccaggagcagcctgctttacagcacagacaacgatatccccgatgtttgaaaacttacgaacgcttccgcctaagcagcggataaccagaacttctttggctcccgtgttgtcagcgacgcgtaatctactttcattctggatcatgaatgtctacctcctgattacagctgtacagctttttcgacgattttcaccagacggaatctcttggtagcagacaatggacgtgtttccatgatttctaccttgtctcccattctagcttcattgttttcgtcatgcgctttaaatttcttagaatattttacacgttttccgtataacgggtgtgttttctttgtttcaacaataacagtaattgtcttatccatcttgtcggaaactacagtcccgcgatatactttacggttagatctttccataacttagtgatcctccttaatcctgactaccaagctcgcgctcagtcatcacagttttgatacgggcaattgtctttttcactgtcttcatacgtgcagtgtttgtcaactgacctgtagcttgttggaaacgaagattaaaaagttcatctttaagcgtttcgatctcttgtaataattcagtgttgcttttttctctgatctctttcgctgtcataattacttctctccttttctaacaacaaattttgtcttcaccggcagcttgtgagcagcaagacggaatgcctcacgtgccacttcttcaggtacaccggcgatttcaaacataacacggcccggttttacaactgctacccatccttcaggagcacccttaccagaacccatacgtacttcaagaggttttttcgttcttgccatgtgagggaagatacggatccaaaccttaccaccacgcttcatgtaacgagtcatggcaatacgagcggcctcgatctgacggttgctgacgtaagcaccagtgtcagccattagaccatattcaccaaaagatacttcacgaccggcttttgcacgtccctcgtagcttaaacggtgaggtcttctatatttagttctcttaggcattaacataaattattttcctccttccgcttttctaggagcatttccaccagcagagtttctgttgttattgtttctctggctgttgtttctgtttccaccacgattaccacggcgattgcggcgtctgtcgttcatgttgttcttcggagcttccggttcctgaaccatctgtcctggcagaacttcaccacggcaaatccaaacctttacacctaaacgaccgtaagtcgtagatgcttcttcccaagcataatcgatatctgcacgcagtgtgtgcagaggtacaacaccttcgctgtagccttcggtacgagccatatcagctccgcccaaacgaccggatacagctgtcttaataccttttgcaccggcacgcattgttctctggattgctttcttctgtgcagtacggaaggaagcacgctgctccagctgatccgcaatgctgcgggcaaccagttttgcgtccagatccgggtttgcaatttccagaaccttcaggtagatgttctttccaccagtcagcttctcaacttttttcttcagcatttcaacgttttcaccgtttgtcccgatgatcacacctggacgagcggtacggatcatgatttccacacggtttttagaacgttcgatttcaactctggacactgatgcattcttgcactcagcgaacaggaattcacgaatctttacatcttccaataataaatcggcataatccttgtcagcgtaccatctggactcccagtcacggatgacaccgacacgcaatccgatcggactaactttctgtcccatgagctacctccttaatcacgctcgtcaaccacaacagtaatgtggctggtgcgtttgtggatcgcactagcagatccttttgcacgtggcatgaaacgtttcagagttacaccctcgtttgcatagcatgcctttacgtacagcttttcttcatccatatcatggttattcactgcatttgctactgcagatttcaataccttaccaactgcttccgctgcaacgttcggtgtgaacttcaagattgcagctgcttcagcagcatctttcccacggattaaatcgataacaatacgagcttttctaggtgggatacgtaatgttttcgctgttgacttaacttccattataacgtttcctccttatcgtttagctttcttgtcattatcgccgtgaccaccgtatttacgggttggcacgaattcaccaagcttgtgtcctaccatatcttctgtaacgtaaacaggcaggtgctccttaccgttgtaaacggcaaatgtatgttccacaaactgagggaatatagttgaacgacgtgaccaggttttgataacttgttttttaccggctttgttcagctcatccacttttttcattaagtggtcatcacagaacgggccttttttaagactacgactcatttttcatttcctcctttgcctatttgccattacgacgacgaacgatcagtttcgttgacgcttttttcgctttacgtgttttcacacccatagctttcttaccccaaggtgtcattggagatttacgtcctaccggagtacgtccttcaccaccaccatgagggtgatcattagggttcataacggaaccacgaacagtcgggcgaacacccttccatctcatacgtccggctttaccgtagtttaccagactgtggtcttcattaccaacctgaccgattgtagcacggcaattagacagaattctacgaacttcaccagaagctaaacgaaccgttgtgtatttttcttcaataccaaggatctgagcagatgttccagcggaacgagccatctggccacccttacctggctttaattcaatgttgtgaatgaaagtaccttcagggatatctttcagctccattgcgttaccgactttgatatcggcaccttcaccggaaacaactgtcataccaacagttaatcctttcggagcgatgatgtaacgcttctcaccgtctgcatagttcagcagtgcgatgttagcggaacggtttggatcgtattcaatcgtagctacacgagcaggcacaccgtctttgtttctcttgaaatcgataacacggtaagctctcttgtgtccaccaccctgatgacgggttgtgatacgtccgttgttgttacgtccacctttgctttttaacggctccagcagacttttttcaggcttgtctgtcgtaatttcttcataggacagactagtcataccacgacgacctggagtggtcggcttatacttcttaattggcatagtgtcaatttcctccttacgcaatatttagtcaggaaatagcgtgcttcttcctgattttattcagcttcttcgccgaataagttgatgtcctgaccttccttgattttcacataggctttacggacattcttggtagtaccaacatatttacccattctcttggttttcggtttcacattcacgatgttcactttctcaacatcaacaccgaagatagcttccacggcctgtttcacctgtgttttgttggttccctttttaacttcaaacgttactttgttatctgcgtccatgtatttcatcgttttttcagtaatgattggacggatgatgatatccttgtagttttccattatgcaagtgcctcctcaacatctttcacagcagcttctgtaaagacgattttgttagcatttacgatatcgtaaacatttaatccatcagcagtaagcatcatcatggtagggatgtttctcatgctcaggaatgcgttttcaaaatcttcaccttcagatactacgaataaggttttcttaggtgcgttgatatcagcgataatctgattgaaagcttttgtttttggagcttccagctcaaacttatcaacaacgctcattgcgttttccagcactttttcagacagagctgatttcagagccagacgacgaacttttttgttcagcttgtagccatagtttctcggagtcggaccgaatacaattcctccgcctctccactgtgtagcacgaatggatccctgacgagcacgtccggtccccttctgacgccaaggcttacgtccaccaccgcgtacttctgtacggtttttggtatcgtgagtaccctgacgcatagatgctctctgcataatgacagcatcgaagatacattgctgatttggctcgatgccaaatactgtatctgcaagagtgatttcattcagctctttaccagtttggcttaatacgaccatcttaggcatcttttattcctcctctttcgtgtaatccactaatgttacaggttctgtattgcccttggaacatttagcagtgcgcaccataaccattccacgttttggcccaggcacgtttcctttaatcaataagtagttgttttcaacgtcaaccttgatcactgtcaggttctggtttgtagttctgtaaccaccttcctgaccagccatcatcgtaccctttaagattttaccctgacgagaggtaataccgtttgtagcaagggaaccgatatgtctgtggtgtccggaaccatggctcttaggaccgattttcgcattgttacgaacgatcgtacccatgaatcctttccccttggatgtaccgataacatctactgtttctccggcactgaagattcctacgttaacttcagcacccagctccagatcagcgaattcgctgtcgcgaacttccttgacaaatctttttggagcagtgtttgctttcgcagcatgtccggcttcaccttttgtgctgcgtgtttctttaacatcttcaaaacctaactgcacagcttcgtatccgtcgttttccactgttttcttctgtaatacaacatttggacaagcctcaactacagttacaggaatcagtgttccatcttctgtgaagacctgtgtcatcccaagtttgcgtcctagaatacctttcatgatgtcacctccattacagcttaatttcgatgtcaacaccactaggcagctccagacgactcagtgagtcgattgtttctgctgtaggtccgacaatctcaattaaacgtttgtgcgttctgatctcgaactgctcgcgagaatctttgtatttgtgtaccgcacgcaggattgtaaccacctgcttttcagttggaagaggtactggtccaacaatttttttagcaccgtgagcttgtgccgcttgcacgatcttttctgcggatgcatccaagattctgtgctcataagcttttaagcgaattcttacgctattttttgccatgaatatatctcctttcgcctatatggactatagactcgctcgatgcgaattccccgacctcgccgtccatgacaacgtttctcagtgggtcggcaacctcgcatgtcctcgcggtcgtgataatattctaacacatccaaatgttgattacaagcgttaattacggctttttttagtttttttcataatcttttccgaatgcgttccctgctgaaaatcaatggtttatgagagcgtttacatgctttttttgataaaaaacacgtaaaaaaacttctaaattgatagaagttttcattaaaacgggaatcgctgcccaataaatttttcacagttaagcaccatctgttcctgcagcttctcataggatatgttacgtatttcactgattttgtgcatactgcgttttaatatggctccatgctcctttggtgcgaccttacgattctcacaccacgtacatgcggaaataccatccgtttccaccagcattcgatccagtgggacacaggctgccacatgctgtaccgcttcatcgaagggcagcgaaggaccgacggtaaaccagcagcccagatcaatatactcctgcagccatgcatcacaggaataccagtgcaccagataccggttttcatagtgacgcaaatattcaagtgcttccttttctcttcccttcagatgcagaatcaccggtttctgatatcgctgtgcaaaagcaagctgctgctcaaacagccgggactgcaacgtcatatccgtgttacaccagaccgtatccaatccgatttcaccgatgatgtccacttcctcaagaatcggcagcattgcatcccagtgaacctcatccaccttccatggatgaataccggcactgatccataggaaaggattcttctcttgcagctttcttaagttcttatattcttcaggtgttgcggcattggcgatacaggcaatgtcctgttcttttaagatttctgccggataagcttcctccatatgcatatgcgcatcaacgatcatgtgtcccctccttcagcagctgatagatctccttcttcagtccgccctgatcatacagccattccctgctttttttgtaatcctttaaagaaatttccctacagatggaagcaggtgatccgctaagaatcagaatgcggtctgccagatacagggcctcttcaatatcatgggtcaccagcagcatcgttctgtttaattcacttctcagcttcagcagccagtcctgcatatcattgcgggtgatgacatccagcgcaccgaagggttcatccagcaataggatatccgcactgcaaagtgccgtccgtaaaaacgcagcccgctgccgcataccaccggatagttcatagggataagcctgttcatatcccttcaatccgaatgcctcgaactcctgcaaggcctgctctctggcttccttcacatgcccgtgaagctttccatataaacaaacattatccagaatattcttccacggcagaagaagatcatcctggggcatataggcaaagtgggaggatacgccgctaacctgcacatcatccacataaaaggttccctcttcacaatccaaaagccctgccagtatgttcagcaatgtggactttccacatccgcttggtccaatcagcgcagtaaactctccctcttccacatgaaagccgacatgctccagtattcttctgttatcaaaagagattgccatatcctccactcgtaatttcatgatgacctcctgtgtcgttttttttatttcgttacaaattcattggtatactgttcatccgccttgattttttcagtgatcagcttgttttcatacataaaggcagtatagttatcccatacggaatccttcataacaccccagctgtccgcatctctggcatattcactgctcagatatttctgactttccttcaggaattttaaatcataatcaggtgcatatttacttaatatttcagcggctgcatccgggtgttcaattgcatattcatatcccttctttaccgcattcataaatttctgaaccgtttccggatcttccttgatcatcttttcactggtgataatgaccggtgtataataatcgaggcgctcatccagctcgcgtaacggtatgtaattcaggtcatagccttccattcttccctttgtgactgcccagccttcaaattcccactggatatccacactcttgccaagggaagcaaagccgctgccatctgcccccaccatcgtcagcttggagaaatctgcctttgcggctgtcattaccgcctttaccactgcttcctcactcggtgcctgccatccggcataaacctttccctcgaaatccttcggtgacttgatattttcctttttcaatgatacaaaaccgcttgtattatgctggatgatggtcgcaattgcacgaatcggcaatggttcctccgccgttctcgcatacgtgacgtcctcctgatagctgacaccgaattctcccttgtttgcggcaaccagtgttgcacttgtcgaatcgtctcccggctcaatgatatccacatccaagccttcttccttgaaaaagcctttttccttcgccacatagaaaccggtatgattggtgtttggaagataatccagaatcagtgttacctttttttctgtttccttgttttcagatgcttcctttttatcagaacatccactcactgcgacagccatcagcacagccatcagcatacagcctaatttcttcatttcgctttccctcttttctttctcgcatatggaaacaacaccgcctccagcaataccaccgccccatgcagcagcagactcagcgcgataataaccactacgcaggcaaacaccttatccagcatatagccgttttttacacggatcatatagtatccaagtcctgcggatgcactcagccactctccgacgatagcaccaccgatacagtaggtagctgctaccttcaatccggaaaaaagtgcagtggaggccgccggtatcttcacatatgcatatatctgccatttttttgctccgaagcttttcagcagactgatctgatgctcgtctactttacccagcgcgtcacagaaggcgattgcgaccggaaagaagcacatgaagatgaccattagaatcttcggtgccatgccgaatcccagccaaatggaaaacagcggtcccagcaccatgaccggtacggtctgcgtaacaaccagatggggaaatatgctgtgtttaaacagcagggaaagatccatgccaatcgcaattacgattgcgagcagtgtagcgatcagtagaccaatgacagcttcctgcagcgttaccattgaatgcagccacagtatatcgcgattcgcaaacagcgcctgtaggatgtttgagggcgccggcagaatatacaaatcaatatcaaatacatgaacacagccttcccatactgccagtaccagaagcagcgtgagcagcggcataccgattctttttaaacgcttcatccatagctctcctttccaataaaaaaacacctccatgaggcgtaagtgaaccaatctaatactcaagatagatatgactccctacgctagcattaactagatcaggtcataagggactgtctcagccttacggcacccctgtcatgacactatcattatacacgctccgtgtaaaaaagaaaagaaaaaagcagacaagctgcttttacaggaaggttaccgctgtaccataggctataacctctgaggcaccacccatgatggcactggatgcataacggatgttgacaatagcgtcagcaccgagagcctctgcctcctccaccattcgcttcgttgccagtgcacgtgcctcattcatcatttcattgtatgccttcagctcaccgccaaccagtgtcttaaagccctgagaaatatccttaccgatattctttgtctgaatcgtacttccctttactagtcccagcatattcagcgttttcccggtaatgtaatcagtatttactaagatcatcttcttctccgctccttatctcgtcaagccgttccttgacaacatgtatccacagaaaaagcagtgccagcatggggatgccaaacaggatcacgagaaactccggtgcatccagaaaaaacagggagctgatccaaatcatcatataaaatgcaatcaaaatgccaattatgataggtgccagcatttttctgttcatactgcccactcccttctgtcgttacctgtattatactacaaaaaagatgggtatccaaaatatttggggggctaaactttaggggtcaatttaggggtctgaactttgagggacactttagggggataaatcccaaaagaaacaggtggcattcatctgtttctttttctataatgttctattggttatgcttctgtgaaggaggtaatcatggatcattcttatctatttaaattattaaacattcccgatgatggttctattatcatcaacgatgttgaaatcatcgctgataccaagtatgtatatatctctcgaccatctatcccgtcttattgccctaattgttcttgcagaatgcactcaaaaggtatttataagcgcaaaatcaaacaccctgtcttacaagacggaacttgcatcatctttatcgtgagccaaagaaagtggaaatgcactaactgttccacatatgttaatgaagatttcccattctttcagcgttataaacaatcctctgatattactcctctactagttttagaggctatgaaagaccttgatcgttctaccgcatctattgccagacaattcaatttatctgatactcaagttcacgatcttttcactgcttacgtggatttgccacgtttaactcttcctgagtttctttccgttgatgaagtacatattgatatttctgaaaaagagaaatatgccttgattcttatggactttacttctggagagattgttgacatcttgcataaccgatggcatcataccattgaaaactacttcttctccattccatacgaagaaagaaaacatgttcgttatattatttctgatgcatataagccttatcttgaattacccaagcatttctttccaaatgctgtgtcgattttagatagttttcatgttgttaaatatttattaggattgattaatacttatatcaattcagtaatgaaagcatataaagatagagatcttaaaaggcttgaaaaacaaaatcatgacaccaatagagacaataaaacgattcaggaatcacaagaagttatcttgcttagaaaatatcgctgggtgcttttgaagaatcaagacaatatcaattactctgacaaaaggtattaccacagctctcttagaatgtacgcagatacatatactattgaaaaactatttctctcactagatcctaagttcaatataatcagagatgtgaaagaaaaatatattagattcaataatactcactttagttctgaagatgaagtaatgcaagaattattaaaaatgattgaagaatttaaggctctcagaggttacattccttgtcttttctcacaataccttgataaatataagcatgagattgcccgctcatttactataactgaggtatcaagacgtagtgcaaaggataatgagcgttactatgcacgtttatccaatggacctatggaatcattcaaccgaaagccgaaagattataagagaaactcacgaggttcctctaattttaattatactagaaatcgaatcttatggtctaccagaaatagacctgcattgagaaatacgcccaaatcatctaatgaagtacatagctatgttggaaagaaacgtggtaaatataaagtaaaagaataaagagattaagaatttgtacagaagcataaccaaaaaaagagaatcagaatgttttttcactgattctcttgattttaactttaggggtcttaatttttagcctttattttttctctcccccaaagttgacccccaaatttctggcgaaaacccctaaaaaatttggatagccaaaaagatacaacacacagaaaaaagagcacaattgtgctcttttcattgtttttataaaattactcgatgatttctgtaacgttaccggaaccaacagtacgtccaccctcacggatagagaactttgtgttgttttcgatagcgattggagcaatcagttcaacgttcatttcaacgttgtcaccaggcataaccatttcggttccttccggtaatgtaataacaccagttacgtcagttgtacggaagtagaactgaggacggtagttagaaacgaatggagtgtgacgtccaccttcttcttttgttaatacataaacctgagccttgaactttgtgtgtggatgtacggatcctggtttagcaagaacctgtccacgctgaatctgatcacggttgataccacgcagcagagcaccgatgttgtctccggattctgcgaagtccagctgcttacggaacatttccagtccagtaacaacagttttctgagtatccttgataccaacgatttcaacttcttctcccagttttactacaccacgctcaacacgtcctgtagcaactgtaccacgtcctgtgattgtcataacgtcttctacagacatcaggaatggtttgtcagtttcacgagttggatctgggatgaattcatcaactgcatccatcagttctttgatagcgccaacgtatttgtcgtcaccttccagagccttcagtgcagaaccacggataactggagcattatctccgtcgaatccgtactcgcttaacagctcacgtacttccatttcaacaaggtcgatcagttcttcgtcatcaaccatgtcgcatttgttcaggaatacaacgatgtaaggaacacctacctgacgagcaagcaggatgtgctcacgagtctgaggcataggaccatcagatgcagcaacaaccaggatagcaccatccatctgtgcagcaccagtgatcatgttcttaacgtagtcagcgtgacctgggcagtcaacgtgtgcatagtgacgcttgtcagtctgatattcaacgtgtgcagtgttgattgtaattccacgttctttttcttcaggtgcaccatcgatctggtcataagcctgtgcctgtgccataccgtcttttgcaagaacgtttgtaatagcagcagttaacgtagttttaccgtggtcaacgtgtccgatagttccaatgttaacatgtgttttggaacggtcaaatttttcttttgccattttaattttcctcctaatttattagtttccaagtatattctaattcaaagtttttataaaagcaacagttaattttcagaactattgtttttaatgattttttctgcaatactcttcggtacttcggcataatggtcgaatttcatagagtaatttccacgtccctgagtgaaggaacgcaggtctgtaacgtaaccgaacatctctgacagcggaatgtgagccttaacgataatcgcatttcctctttcttcctggtcaacgatagcaccacgacgggagcttacatcacccattacagatccaagatattcattcggtgcagttacctccaccatcatgatcggctccagaataaccggattacatttcttggcagctgcctttaatgccatgctagccgcaattttgtacgccatttcactggaatcgacatcgtggtaagaaccgtcaaacagcgttgctttgatatcgattacctgataacctgcaacgataccgtttgccagtgcgtctctcagaccttcttctgtaggcttgatgtattcacgaggtacgcttcctccgacagtagcatcaacaaattcaaatccttttccctcttcctgaggctcgaatttgatccatacatgaccatactgtccacgaccaccggactgcttgatgtatttaccttcacactctgcagtaccacgaatggtttcacggtatgcaaccattggctgaccaacgtttgcttccaccttgaattcacggcgcagacggtcaacgatgatgtccaggtgaagctcaccgacaccggcgataattgtctgacctgtttcctggtctgtataggttttgaaggtaggatcctcttctgcaagcttcgcaagagcaagacccatcttatcctggtcagccttggtcttcggttccagagacagttcgataaccggttccgggaattccatggattccagaatgattggagaatcctctgcacataagctgtctccggttgttgtaaccttcagacctacggcagcagcgatatctcctgcatatacctgatcgatttccttacgggcgttggcatgcatctgaacgatacgtccaaaacgctctctttttccctttgtggagttcagaacgtagcttcctgcctttgctgtaccggagtacacacggaagaaggaaagctttccaacaaatgggtccgttgcgattttgaatgccaatgcagcgaatggttcttcatcactggaatgacgctcggattcgcttccgtcctccagcgttcccttgattgcaggaacatccagtggagaaggcagatattcaacaacagcatccagaaccatctgaacacccttgttcttatatgcagaaccacataatacagggaagaaatcaccagcacatacggcgatgcgcagaacacgcttgatgtcctcaacgctaggttcttcaccctccagtacctgcatcatgaaatcttcatcataatcagcaaggtagtcaatcagcttggaacggtattcctcacacagatccttcagatcttccggaacatcgccttcctgaatatccgtacctaagtcgtttgtatagatttcagattttcttttaatgatatcaacgataccagtgaaagtggattcagcaccgattggcagctgaatcgggcaggacttagctcccagacgatctacaattgttttgcaggacatcaggaagtcagctcctgttgcatccattttgttacagaatacgatacgaggaacaccatatgtagtagcctgacgccaaacggtttctgtctgaggctctacaccggcttttgcatccagtaccgttacggcaccatccagtacacgcagggaacgttcaacctcaaccgtgaagtcaacgtgacctggagtatcgataatgttgatacgggtacccttccatgctgcagttgttgctgcagaagtgatggtgataccacgttcctgctcctgtgccatccagtccatcgtagaagctccatcgtgagtctctccgattttgtgattaacacctgtataatacagaatacgctctgtagttgttgtcttaccagcatcgatatgagccatgataccaatgttacgtgtgttttctaatgaatactgacgtggcataatggatctcctttcttaccagcggtaatgagcaaatgctttgtttgcctctgccatcttgtgagtgtcctcacgtttcttaacagatgcaccacttccgtttgctgcatccatgatttcagcagcaagtctttgctccattgttttctcgtttcttaaacgagcatagttcacgatccaacgcagaccaagagtcagacgtctttcagcggatacttccaccgggacctggtagttggcaccaccaacacggcgaaccttaagttccagtaatggcattacgttttccagagctttctcgaaaacttccattggtttttcgttagtttttacttcaataatatcgaacgcattgtacagaatcttctgtgcaacccctcttttaccatcaatcatgatcttgttgattaaacgagtaaccagcttggagttgtaaattggatctactaatacatcacgttttgctacatgtccttttctaggcattcgaatttcctcctttcacaattgattatttcttagcttcttttgggcgttttgctccgtacagggaacggctctggttacggttcgcaactccggcacagtccagtgtaccacggatgatgtggtaacgaacacctggaagatccttaacacgtcctccacggatcattacaacactatgctcctgcaggttgtgtccaataccaggaatgtaggcagtaacctccataccgttgctcagacgaacacgggcatatttacgcagcgctgagtttggtttcttcggtgtcattgttccgacacgagtacaaactccacgtttctgaggtgcacttaagtttgtaggacgtttcttgattgagttatatcctctattcagagctggtgacttggaaagcttcacgctctgttcacgacctttacgaattaattggttaattgttggcataatatcctcctttcactaacacacatttccgggtgtgtcatttcgaagtgtaaatgtagttcccgcagaacgggaacctcaaaaatccacttgcctaataatcataaagcaactgaaatagcttgtcaacaccttttttatttttctttgtaaaagatttgagattctagtataataggggacgaatagacatagagggaaagtagaggtttcaagtatggcttataaaatcgtgttttttgatatggatggtaccttgtatcagacagaaaacgacattattcaggagtccagtcttcaggcgattcaagcattgagggatcagggctatatcgtgtgtgccgcaacaggtcgaccgctgaatcagatgaatctgattctggagcgtgtacagtttgattatatggtgatgatcaacggcggctatgttctggatcgtgagcagcgcctgctgtttgaaaatccgcttgacaggcagacgacgcaggatatcgtagactggtgcgagcagcaggaaaacggactgatgttccatttcggagatacatcctatatatatgataaattttatccgttttattatttctgtcgagaccaccatgttctgaattatctgttctatgatgaacagcgctcttatcataaacggcacaatgcctataatgcagtcctgatgacaaaggagcagcgctccctggaggaatttcttgcaaagcatccgctgctgcgcagcgatctgatcgaggttgcacaggatcatttctgctttgatgtattcaatgcaaataacgataagtttgtgggaatcaatcaggttctgcaaaaagaggggatttcctgggaggaatgcatttgctttggcgacagcaccaatgatatcaagatgctggagatggcaggtatgggggttgccatgggaagtgccaccgattacgtaaaatcctttgccaacatggtgacagcctctgtctatgaccatggaacagcgcgtgcattacaaaaaattttaaatctgcagctcaaactatagcatatttttaacaggcagatataacgcatgaaaaggagacactccagcgttgtgattatgctttgttgtcaaggctattgagagtcaaaaaatgaaattacatatatcagaagaagaccgctcattgaacggtcttccttttcttattctctggtttctgttagtcctgatccttcattgttcattggccagaatggcagaagtccgatcaatgcacctgccactgcgggtagaatccagccgatactcagctcataaaacggtagctctgcaaaccagtcactgattatccccaaggaaacacctgcactttccataccatttacgaaggatactgcaaaggtgaacagcatcgccatgatatacaccattcgccgtgatccgatccgctgttttagaaaagacagaagcatcagcaccacggtgagcggatatatcataatcaaaattgggagtgatacagtgattaactgacttaagccaatattggaaatcacaaagctgaacaagcagacagcagcagctattcttttataggtccagcgtttgggcagtatggtttgaaaataatccgcaaaggatgttgtcagtccaattgaggttgtaagacaggcgaatagaacagcaattcccagaatgattccaccgataccgccaaacagatgatttgttactgcatgcagaagtgctccgccgtttgtgaagggcgtattcgtaatggccccgacataggtgagcataaaataaacacctgccagaaagcctgccgctccaagaccgcagagtattgtataacgagcaatgtatttcttatctgtaacaccataactgcgaattgctgttataacaagaattgcaaatgccagccctgccggtccatccaatgcattatagccctcgatcatgcccttaaaaaacggaatatcagcatatgcaggggacggctccatcatggttccaaaagaaaatgcaccattgcttgtttcctgtaaaagagaggcgataaagatagccagtatactgatcagcaggaccggcgtcagatatttgccgacaacatccacaatcctgcttgggttgctgctcagatagtaggtaagtccgaagaaggcagctgtaaacagcaatgaccatagtatggcattgttttcccctatgtagggaagcaatgctatttcaaaagaaacacttccggttcttggcagtgcaaacagcggaccgattaacagataaacaccaaccgatagaaccaaagcgaacctccgactgaccagatttcccagatcactcatagaagttcctgccagtacaacagctgttactccaagaattgcaatacccgcatcagtcagaataaagcctgcaagggcactgatatagctcgttccagccagttgtcccatagcaggaggaaaaatcatgttgccggcaccaaaaaaaattgcaaaaagcatcatagataccgatataatttgaataagtgttaatttcttcatataaaagctccttatattcacgcctattcatcatagcggaaaacaaagcgatacgcaatcactttttcactgttttagactgactgctgtaaatcataatctgcatccggcagctatttttcgacttagcctgtatataattacagaaagaacagtaatcagcattcactggcaatgttacatcagagacactgctaatcaattttcggtatacaagatactgtagttacatataggttatggcaaaagaaaatgtaagctattgccaagagcacacaatccacagatcgaacagaagacacaaaacaaaaaaagacccatcgtaagatgagtcagattacctggcagcgtgctatcttcactggagccagtccagatattgtcgccgctgatatgcttaacttctgtgttcgggatgagaacaggtgtgtccacatcgctatcgccaccagatcactttgaggtctacccctcaaaactgaataacagttgacagtttctttttgtaccacctggtacgtgtgattaagtcctcgacctattagtatcagtcaactccatgtatcgctacacttccatctctgacctatccacctcgtcgtcttcaaggggtcttacttcgttatacgaatgggagatctcatcttggagtaggcttcgcgcttagatgctttcagcgcttatcccttccctacttagctacccagctatgctcctggcggaacaactggtgcaccagcggtaggtccatcccggtcctctcgtactaaggacagctctcctcagatctccaacgcccacaacagatagggaccgaactgtctcacgacgttctgaacccagctcgcgtaccgctttaatgggcggacagcccaacccttggaaccgaattcagctccaggatgcgatgagccgacatcgaggtgccaaacctcgccgtcgatgtgaactcttgggcgagatcagcctgttatccccagggtagcttttatccgttgagcgacggcccttccattcggcaccgccggatcactaatcccgactttcgtccctgttcgacttgtttgtctcacagtcaagcacgcttctgcatttgcactcgtcgattgatttccatccaatctgagcgtacctttgggcgcctccgttactctttaggaggcgaccgccccagtcaaactgcccacctgacacggtccctcacccagttcatgggtgcaggttagaacttcaatcaaacaagagtggtatcccaacagcggctcctcgtatactggcgtacacgtctcttcgcctcccacctatcctgtacatctttgatcaaaattcaatatcaggctacagtaaagctccatggggtctttccgtctagttgcgggtaacctgcattttcacaggtactaagatttcaccgagtctgctgccgagacagcgcccaaatcgttacgcctttcgtgcgggtcagaacttacctgacaaggaatttcgctaccttaggaccgttatagttacggccgccgttcactggggcttcaattcattgcttctccttgcggatgacaaatcctcttaaccttccagcaccgggcaggcgtcaccccctatacttcgtcttgcgactttgcagagagctgtgttttagttaaacagtcgcttgggcctcttcactgcggctctcttttacaagagcactccttatcgctaacttacggagtcattttgccgagttccttggcaacagttctctcgctcacctcaggattctctccttgcccacctgtgtcggttttggtacgggccgctatggaatcaatactagaaacttttcttggaagctggcatcatgtgcttcagtacttgcccggaggcgttcccttacctgtcacatcttacatcctgctgacgcatttcactgtcagcctgctatatgcttcgaccacaatccattaagtggctcacactagccttctccgtcattccttcatttccatcgcgggtacaggaatatctgcctgttttccatccactacgcctttcggcctcgcgttaggtcccgacttacccagggcggacgaaccttcccctggaatccttgggctatcggtgtgtaggattctcacctacatctcgctactcacaccggcattctctcttccatgctctccaccgctccttacggtacggcttctacgtgcatgcaacgctcccctaccactcaactctaaagttgaatccgcagcttcggtagtatgcttagccccggtacattttcggcgcagggtcactcgactagtgagctgttacgcactctttgaaggatggctgcttctgagccaacctcctagttgtctgtgcatccccacatccttttccacttagcatacattttgggaccttaactggcggtctgggctgtttcccttttgaccatggaccttatcacccacagtctgactgccgagtacgtcttcatggcattcggagtttgattatactcagtaccccgggatggggccatcgtacattcagtgctctacctccatgcgactctgcctcgacgctagccctaaagctatttcggggagaaccagctatatccgtgttcgattggaatttctcccctagccacaactcatccgccaacttttcaacgggggtcggttcggtcctccattcagtttcacctgaacttcaacctggtcatggctagatcacacggtttcgggtctacatcatcgtactgtcgccctattaagactcgctttcgcttcggctccgtatcttctacttaacctcgcacgataacgtaactcgccggttcattctacaaaaggcacgccatcaccctttaacgggctctgacttcttgtaagcatacggtttcaggttctatttcactccgctcccgcggttcttttcacctttccctcacggtactggttcactatcggtcacttgggtatatttagccttgacggatggtcccgcctgcttccgacaagatttctcgtgtctcgccgtactcaggataccactaggcttcacattgctttcagttacgggacttgcaccctctccggtcggcctttcaatgccgttctcttagccatgctcttgccatttcgtggtcctacaaccccagatcaagatctggtttgggctcctccgcgttcgctcgccgctacttacggaatcattcttattttcttttcctccggatacttagatgtttcagttctccgggtacctccctcatgagctatgtattcactcatgggtgacagctcattactgctgccgggtttccccattcggatatcgacggatctttgtgtacgtaccactccccgtcgcgtttcgccgtttgttgcgtccttcttcagttccaagtgcctaggcatccaccgtacgcccttattcacttaatcacgattaagttctaaagcgttcttttctttgcttaggtttttgcttgagttttctgttttgtttaactttctactcgtgaatatctatgtttgtttacaactttcgttatagaccttcatatgtcttctgttattcagttttcaaagatcgacttcttttcttctggaagatcagtcttccaaaactgaacaggaaatgtccgataactcttcttttgtactttctccttagaaaggaggtgatccatccccacgttcccgtagggataccttgttacgacttaaccccagtcatcggtcctaccttcgacggctcactccttacggttatgccaccggcttcgggtattactgactcccatggtttgacgggcggtgtgtacaaggcccgagaacgtattcaccgcagcatgctgatctgcgattactagcgattccgacttcatgaagtcgagttgcagacttcaatccgaactgagacgacctttatgagattcgcttcacatcactgtgtcgctgctctttgtggtcgccattgtagtacgtgtgtagcccaggccataaggggcatgatgatttgacgtcatccccaccttcctccggtttgtcaccggcagtctcgcatgagtccccaacttgatgctggtaacatgcgacaagggttgcgctcgttgcgggacttaacccaacatctcacgacacgagctgacgacaaccatgcaccacctgtgtgatccataattatctctctatctctagagcctttgcatccatgtcaaggcctggtaaggttcttcgcgttgcttcgaattaaaccacatactccaccgcttgtgcgggcccccgtcaattcctttgagtttcacacttgcgtgcatactccccaggcggagaacttattgcgttaactgcagcactgaattcctccaacacttagttctcatcgtttacggcgtggactactagggtatctaatcctatttgctccccacgctttcgtgcctcagtgtcagttacagaccaggcgaccgccttcgccactggtgttcctccatatatctacgcattttaccgctacacatggaattccatcgccctcttctgcactccagcataccagtttccatagcttacaatggttgagccattgccttttactacagacttagtacgccacctacgcaccctttacgcccaatgattccggataacgcttgccacctacgtattaccgcggctgctggcacgtagttagccgtggctttctggtaagctaccgtcactcccatagcatttcctctatgagccgttcttcacttacaacagagctttacgatccgaagaccttcttcactcacgcggcattgctcgttcagggtttcccccattgacgaaaattccctactgctgcctcccgtaggagtttgggccgtgtctcagtcccaatgtggccgtttaccctctcaggccggctacgcatcatcgccttggtgggccgttacctcaccaactagctaatgcgccgcaggtccatccatgttcacgccttgatgggcgctttaatatactgagcatgcgctctgtatacctatccggttttagctaccgtttccagcagttatcccggacacatgggcaggttacctacgtgttactcacccgttcgccactaagtctctttggaagcaagcttcctcgaaacttcgttcgacttgcatgtattaggcatgccgccagcgttcatcctgagccaggatcaaactctccatttgatttagctctaacgcatgacttgcgtttgaatttcatttttgttatcgttataccgagaatattgttttctcaaataattgacgtttcctgttcagttttcaaagaccgaaatttctatttcgtgcgccgctgtttcgttcggtgcctgtatataatacctcttttaaggatgattgtcaacgattttctactctttttttatatttttttgtcctttttattttaaaccgctatgaatgtaacattttttcaatttatcgcctatttctttatagaatccttacctataacagaccttttcttcttttacacctgtttatgtgctttccagctcctgcatgctattgtacttcatttccttcctacattcgtaggtcagcagctaacacagcgtttcttctgtaatcaaaatgagtaaggagcattctcctgcaatcatagcacatatacagacatcacaatcatgcaattatgacaaggaagcaccttaccagcacactcgcatgtgacaaatactgtcactgtgattcacataccaagtgcagcttctattcgctaccattctttaatatatatgaatgataacatcttccttgtatcggtatctatctgcaatacattaaccttggcttgccggttttctcctccatcccttttctttctcttctgtatccccagctgcattatcactgaaaaagaagtatcaaatcattttgatatgaaaaaaggaaatccaaaagattgcgcgggtcaatgtattttaaatttcctttttataggcagcaatgcacattcagcaagcccgccttttttcattttataaatgtatttaacgatacagcatataatccagcatatctttataaaacccagccctttccaacaacgctgcagctgcttttggatactctttcacaagcagacgttttttatcaggataaatccgttgctcacgatacgtctgaacaaaggcatgcagtgcttcttcagccaagcttatatcaaaaatttttaaaacagttccctgacgttcaaaaaccatgatagcagttcctcctgccagagccaccgcagttcctgctatattcataaaggccgcagaatccttatgctccaatagcttcccccatggctgcataggatcctgagcattcaaccagcagatttgttgctttggatgagccagaatatgcatactgccttcatattcctgctttctaataaattgcgcaccggacatcccttttacaaaatatcctctgcgtacacggccggtgaattcccagatactaagcagatgcaaagcatcccgccagctgaaattttgttcctgttcctgctgttgtaggaatatgcgaaaggtttctctgcatacaataccgtattcttgaaagcatgcctgaatcagcgcctcttccgggatcgactttaacggacgcagtatatcccaccttccggatgacattgcataggctctggcatggagctgctgcttagcggatgcctttttcattttctttcgattcagccattgtcgcaccggcgtaaagctgtccgcacagacaaggccctgctctgcaagccgcagcagattagcatgcacatctccggcctgcggtatacgattgagtgcatgcagaaagcttgctccctgaattttgagtcgttgataaatccgctgctcctgcgtgtcctctgtctgcatttccctgctgccgtcgtttacagcagctgtggattgttcccagtcgatatcctcgtaacgatgaaagctcagcatgccatcgggatgcagcttccagaaatattctccctgtgccagctcctgatccagcagctccggctgatagccgcttatacgggatggcaataaaaccgtttcccataatgaggctgcatgtttctgattacagaatagatccagtgtatccttcagctgatctttgacaggggcattgtgaaaaacacggctcacaaggagagcggcatagtgatgagatggctgtgttacagcctgaatgcgtaaattgcggattgtttgttttcttgcacgttcatactgtttggaatgataatagcagccaccatcctcgatgacttctttttccgaacaaagctgctgcaaccagaattgtacagcttcctcctgcgcaagatatcgctcctgcagctgctttagcgtctgtgcctgccgatagtacagcatgcggcgtatgatatgcattccggcttcagacttatgctccagcagtgcctgctcatactcctcgcgctgttctgcggcgatccagagaccgggttctatgtaggtgatcaattcctgagaggtcagttcatgcagccagtccgctatccgaccttccgcatgtttaacatccatttcgcccgtacatgcagccttaatttcctgtgctgtcatatccccttccatcataagcagcgtatgcagctcattggcagattgcatcgtctttttccgcttccccatatgctttagtgcctccagggaaggctttatttgttccatttgctgtaattcttcatatactgcctgctggatccccggtgttgttggtgtatattcatacatttctgcagcttccacacgccactgcagtggcagtgataacggggaaggcgtgtccagctgcagttcatgcacatggatatccccactgcgaattgcatatagaatttccagtaatccctttaaatcccactgatcctccatgcattcgcgtttggtttccacaatcagaggatgatgttcctcctgcagcagtgcttccagcatttccgtactgcgaagccgctgcatccacaatggctgtcttttgtttctacgcattcccatcatgagagcacgtgcagcattatagcggaaattcatactgaaaacaggtgtcagtggaagcatgacttccagaattttcgaagctgcttccggattaatattgtacagcagcccttcttcgattttcccttcaccataggaatataaaagaataccgtcttcttcatccacacttccgatatgcgtcctggtcactctctgagcagcatcctgcagaagcagggcaagaggagcattgattcttcgaccgaacatggtatgaagcatagcctgcggacttccggaggaatctctaaaatgctcaatcagaatcgtctgatcatccggcaggattttggttgccttgatctgccgttttagaaactcgctcgtattttcgactgctgcagcatccagccccagcgtctgtaattcctgttgcagtgtattttgacgatatgcctctgacagcttcctcataatagcgccaaaggccagacttgttttcagactccggcccttgatttcccctttccaaaagggcagacgggccccctgcggataggttggcgtcacgaccacactgtctctatccattccgacaacctgccaggcattcgcccccagcataaagcgatcacccagacgggtttcatagacaaattcctcatcaagctctccgactttaacaccatcctcagtttttgccgcgtacagtcctttatctgggatagttccccctgcagcgacagcgagcattctgctgtaggcttccgcaagaacacatccgtgtaatcggtcataaagtatgcgcgggcgaaccggaacctctcttttatgctcaaaatccccagccagcatgcatagaatagcggttacctcctgtttgctgacatcctggaaggtgtaggtgctttgcaaaagctccatgacatcgtcaatcgtataggcgatcccggtaagatgccattttctttcaagctccgtatgggaactgcttgcgattgcggccatggagacgagatgctgtgccagaacatccagacatttcttcggcggggatgcctgctcaataccgccggctttcgcaacagctgcactcataccgcaaaacagtgtttcctgtgaggttcttgggtacataaacatatagctggtttgaccgggattgtgaccggcacgtccaagacgctgcatcgtactggagatcgagcgtgggcagccaatctgtaaaacctgatcaatacttcccacatcaatccccagttccatggaggaggtggcgcagagcagacgaagtgtaccgtttctcagggatgcctctacctctaaacgctgttcctttgacatactgccgtgatgtacacgcgcaaagtcctcaccgccaagctggtttacataataggccagcttttcagcatatctgcgtccctctgaaaatgcgatgacacttctgctttccaggcattttgcataaacactttctgcgagctcctcccagaccggatcctttcttctgcccagcgcaggagtcaagccgttcacctcgatatgtatttgcttctgcatactgggagcgatcatgcttacggtatccagagacaggtagtcagcggctgtctgcagcggctcaattgttgccgacaggccaatgcgctgcagctttcgtttacatagcttttccagcctggctatggaaagcatgagatgcgcacctcgtttggtgtcaatgagggcatgcagctcatcgatgatcaatgcctctgccgtatgcaatatcgtttgacctccggtgccagtcagcattaaaaacagagattccggtgtaataatcaaaatatgaggaggatgcttgatcattctctgccgatctctttgcggtgtatcaccggtacgtatgcctattgtgatattcgctgcgccttgcccgttttgttcctgtgcaataccagataagggcttattcagattttcacgaatatcctgtgcgagtgatttcaagggagatacgtaaatcaggtacagctgatccttcagttttccctgatgagccaatgcctgcagcttatcgataaaaaccagaaaggcagagagtgtttttcctgtcccggtcggagcgctgatcaaaacagagccgccttccgcaattacaggccatgcttcctgctgtacagcggttggtgcagcgaaggtatggcagatccagtctttagtgggctgtgtaaacacatgcatatagctgtctttcttttttcccattcgatatcctcctgctttctacttatatgttttgcgaatttcgtatacttataacgattttatcatacttccggagttgtgccaaatcagcttttctgattgagccactcataaggatacctgcttcgccggaaacgaaaaagacccgcgcaggtctttatgaatgctcatttaaataacgtttttccacatagctccaatcaatcagcgcgaaccagtttttgatataggcagcgcgttcactgtaatattgcagaaagtaggaatgctcccagacatccagcggcagcagtggtacaagtccctgtggcagcggcgtatcctgattctttgttgtaacgatacgcagtttagtaccgcgatcttgtaccagccatgcccagccggaaccaaacacacgcagtcctgcattcagcatttgttccttgaaattctcaaaagagccaaaagattcctccagaacattacgcatatagttactcggccggcgatacttgggcgtcatggctgcaaagtaggcatcatggttatatacaccgcctgcattattatataccgtagttcgtatttccacaggcagacgatcattgtctacgatcagccgttccagattccagcgttgaaagcgtggatatttctggagagctgcatttaatctgtcaacatatccctgaaaaagtgtatcgtgatgaatgcggatggtctgttcctccagatacggctccagtgcataataccgatacggaagcggtggcaatacaaaaggatagtgttcattcatagattttcacctcaccttctccctatgctatgtgaaagatgtattttattcaccactaccgcctattgaatttccttgattctattttcaaaataatctaaaaagagaacaaaaagctatacgtggcattcccccctttcgtaaacggagcattctgtatgccagcagctgccgcatacctttgttctcgttttgaataaaacactggaaaaggtattttcctattcatttataaggcttcctttttgcagctattcaacgatcgatccttgagagaattacagaatttccatacatcaggaaaatccgcactatgatagatcccccctgttatcgcttatgttttctgcaggattcgcagtagttgcgtcgtgaatgtaattatatttatgtctacttatgtgaatatccggggcgttatctatacaattttttccatcagtgctataatattacataatttgttttatataatcggtatttatcactgcgagctttagaaacagaagaaatcattatacaaatcattgaataagacaaattataaatgcttgatcgaaagggagggagacatcttttacatggcaatcgctttcctgatatcatatgccgaatcagattttttgcagggcctgcaataccctttatgtttttatttcaggaattggcatgaacgtgatcttgtgtgattctctgcatactgatatttgtatctgtggtttattcttcgaatcctgtaatgaaatattgctgtgtaaacaaaatagcttatgaaaaaacgatatttgcaacaaaatgtatatcaggccttattggagcgtctccactttatatttcatgaatttgatgtcgtatatgtgtctttttcgggtggaaaggacagcggactgctgctgaatattcttttggacttccgagataaattttatccctcgacatccatcggtgtatttcaccaggatttcgaagctcagtaccgtgctactacggagtatgtagaagaaacgttcaggatgctggaaaaacgccccggggtggaattgtattggctttgcctaccaatggcaacaagaacagcgttaagcagctttgaaatgtactggtatccatgggatgataaaaaagagacattatgggtacggtcaatgcctgaatatgattatgtcattaacctgaaaaataatcctgtaacgacatatcactataaaatgcatcaggaggatctggccaagcaattcggcagatggtatcgcagtgtgcatgataacaaaaaaacgatttgtctgctgggtctgcgtgctgatgagtctatgcagcgttacagcggttttgttaataaaaagcacagctataaaggcaaatgctggattacacagcaattcaaggaggtttggacaggttcgcctctgtatgactggtcagtcgaggatatatggcatgcctattataagttcggatatagctataacagtctgtatgatttgtattacaaggcgggattgacaatttcacaaatgcgggtggcttctccgtttcaggattatgctaaggaatcattgaatctatatcgcgtgattgatccacagatgtgggtgaagctgctgggccgtgttcagggagcgaattttgcggcaatctatgccaaaacaaaggcagtcggatatcgaaccataaaactgccggagggacatacctggaaatcgtatacaatgttcctgttggcaacacttcccaaacggctgcggcaaaactatattgaaaaattcaataagtcgataaccttctggcatacggtaggaggagggcttgaggaagaaacaatcgaagagctaaaggagcatggctatcacataaagcgaaacggggtatccaattatacaatttttaaaaattccagaatcatatttctggatagtataccggatgataccgacgatataaaatccacaaaggatatccccagttggaagcgtatgtgcttctgcattttaaagaatgaccatatctgccgttccatggggtttggattaacacgggaacagcagagacgactggatcatttaaaagaaaaatacaagggtacggaggtttagatgatgagtaagagtccggtttatcatatacgtgcagttccaatagaaaaaatcataccgaatgattataacccgaatgccgttgcgccacctgaaatgaaattattgtatgacagtataaaggccgacggctacaccatgccaatcgtatgctattacgatgaggctagcgatcattatatcattgttgacggctttcacagatatcgcatcatgaaggaatacccggatatctatgagcgtgagaagggggttttaccggtttcagtaatcaataagccgcttgaccagcgtatggccagtaccatacggcacaatcgagcaagaggtagtcacgatgtggatttgatgagtaacattgttaaggaattacatgaacttggacgttcagatgcatggattgcaaagcatttgggtatggatcgtgatgaaattctgagattaaagcagattacaggacttgccgcattgtttaaagagttagatttcagtcaatcatgggaaccggttgaggatgaggagcatctgcagagtattgaggatcaatttgtcgatgcttaaaacagttacattgaatttataggaatcaataaacgtaaaaaaacgttcggctgtattcaacatgccatttagttaagaaagttgacaaaaaaaaggaagatcagagaaatgacaacagagaatgtcggattctggtcttttaatataagaatgattcagaaaaaggaattttggaaaaagtatgatgcattctacaatacaatggagcatgagttaacaaagctgcagaatcatccaaagaacacggataccctatttccatatgcgccaatggattgcttgattctacgtttcttatcataaaagataatcaaagctgttaatctcggcacaataaaagacgatcaagcaaggctaaccccctttaatttgatcgtctttttcaatcacttgtgtcaatgagacatcagtcttcataatttataccaaaccagacgactctactctcacttaactaagcacatttatgaaagaaaattaaaaccatcttcacatatttgtataattacttttcattcatagtttgcaaagccttgaacagttcacagactataatgcttatggcgataagtaaagccaatactataatggttatgtaccatattagaaaataaaatccatttaacagagttagtgacaggaaaaaccatgcagcaaaaacaaacataacataccagatgataatattccttattttttttgaaaacattttcattttaatcaatcggcttcaggactgaaccataatctttagataagtccacagcataatgcttttgaaatagtattttagcttgttgagaaggcgaaaatgaaatatttatcttactgccacttagactaaatgaaggtgttatccctaaaacactatttgtatatccagctaaaacctcactcatttcctctttacctgaagttacgaagtaactattcagtcttgcaacagatacattttcaaaatatgatttattattcacatcatcaaaatataggaaattttgtacaggaaatgtaaaataattagaacctaatccattgtatccaatacttgataattcagtatagtgctgcattctttcacttccattaggctgtctatatgtaatcattgcagactgactatgatcggttcttgtgtaacgatgtgataatcctgtcactccgtttatcatggtgtgttttgactcagctatgaccgggctagaccaagtgaatgttgcgtgcaatcccatatatgttttgttctctttaggaacataagtatgaccacttgtcattactttaaccgtaagggtagaagacaccaacgcccttgtagcattcgtataatcataattttttatgccatggatttgctcttctgtaaatcccattcctagtaattctatatcagaatatttattatattctagtacttttttatcaaattctgtgatattagaaaaacttcttgtcataggatttttttgtaaagattcaaattcgttaattgtaaatgaatctattaaaatatttgattcatccataaattcctttaattcttctgaaaaatctgtatctggcaattcttgtgcataagataaactagaacaaagaatcgcacatgttagaatcatacaaactttacttaatgtttttttcataacttccccttccctgcatttgtgcataatcaagttatttataatcttatcataactgcctcttcaaactatataaacgttatatatctatagtttatcagtacataagatgcctgtcaacagttattacccatgattttttcgaagctgaagtgaaaagttaaattccactttcaaagtagctaagtagaaaagactcttacacaacaatctagttgaatttacacttacaattgcatttagtctttcatatatccttttttatatctatgatgaaggtaaccgctggttattatcatacacattacaaagggtgatgaatatggcaacgaacaaaaacaaacatctgactcaggacgatcgcaatgtcatcgcgatcggcatcgttaatggttcttctaaaaaagctattgctgataatctaggcaaagataaatctacgataggtaaggaaatccgtgctcaccgttatctctctcataaatctacactttctctagaatgcgagaactatgctcactgtaagtttaagagaaagaattgtactgtcaactgccctgattattctaagttccgctgtaaacgcagagatcgtactccgggagcttgtaatggctgtgagaaactgaaaagctgccgctttgataaatacctctataaacctacgatcgcctatgaggaataccgtagcgaactcgttgagtctcgaaccggaatcaatctgacctcatcagaagctgtagagctaggcaataccatcaagcctcttctattaaaaggtcattcaccttatcagatcatagctgcacatcccgaacttggaatcagtgagaagacactctacaactatattgaacaaggtgtattcgaatgtgttggcattgctaatattgaccttcgtataaaagtcaaaagaaaaatgaccgctaagaagaagacgatctataaaaaacgacaagaccgtaaattccttgttggacggctttacacagattaccaatcctatgttgagtctgaggaaatcacacacattttacaaatggatacagtctataatgacatttccaatggaccgtttatccagactttcaaattcatcaaatatgggctcctgtttgctgtatatcacgacacgaagactgctgcagatatggttgacggactagctgttcttgattccatccttggaaaaagcctgtttgaacaggaagctcatataacactcactgatcgcggaggtgaatttactgatgctgagcatatggaaaaaagagacgatggtaccagaaggacacgagtcttctattgcgaccctatgcagtccgggcagaaaggaagcctggaaaatatgcatcgtgaattacgttatatattacctaacgaagtagacttacgcagtatcggcctgaccgatcagacttccttgaatgtagccatctcacatatcaattccagtgccaaggaacatttgaatggaaaatccccatttgagctatgtgagttcatgtgtccggaattagcgcagaaactttatgaatttggtctacagaaaatagaaaaggacgaagtgatacttcgtccaagcgtattgactcataagtaacaaacagatgatataaagaatgataagagcagcggcaaagaacagttatttatagtgtaactataaaatagaagtggaatttagttatacataggcataatggagcctattttcagtgcgcttatccattttatctatcattcgcacaatgaccactttcttcacatttttacttacttctacctatttgaaaccctttctaacgctatatttatgctctgtatagacttttgtagaagaaagttccacattttttattcgccttttgaaagtggaatttaacttttcacttcagctgattttttcgaatgttggctttttaagaagtaccttaaaaggaattagaataagtatatcttgaaaattattttaggatatttgtcagcgggcttatcttcttttaaaagatttacatctaaatttacaatgtggtaatctatgtatgttcattttatgacctcctcatcctttaataagtgttttggcagaccctctgctattttggaattttaattttctcattacttttcataatcttaagttattttgatctaccaataaagatcaaatcattgcataaaaaagctttattacatagagtctgctgaaaaattcgtcctattaaaaaaaatgaagacagaatagtatcaactatggaaaagattatgaaattatggcacaaagtgagatatcctattggatttccttgcttttttcttgctttaacttaatgattcttttcatatttgccaggaagagcgtactcgccccttgtatggttatgcctaaaagaccgcatgcatttgcggcaccatatccatattgacttttcagttcaccatttttggcttctattttatatcgctcattatataattctttaaattcatcgcttgccatatagtccatatgtttcaaatgtacatcatctttgatatttacggaaaaggattttgtttttgccccttccttataacatcctgctttatgtgggcaatgcttatatttttccacatcaaaataatacagttcaacctgcgtgttgtttccattcttatcgcatttacttccacttttgacttttttgattgccatatgtccagtttgacacacatacttcaaacttgtctttgtttttgccatttccatgagtcacacttttgcttaattttgatatcagctttataccctctgcttcggcgtactctaaattatctttttctgaatatgctccatctcctatcgctgattctacttcaacccctgctgcacgacttattttcactaacggctgtaattgcttgccgtcatgcttttcgccacttgtaattattgcagctgttatgattcgctcttgagtcatcgcgatatgtgtcttgtagccaaagaaggatgtatctgctgtcttatgaccaacctttgcatcctgatctttcgaatactctaactctatctgtgtatctgccactccttctttcagataattattgcgttcccttaccgtttcgattacttccatccttggatctgcatcaattactgctcacagttcattgcagtatgctatttcgtcttccaataagccactggatttacgcttcttcggcattttttctttcatatccggattgaccgcatataccgctttacgcagttctctcgctctttttatcaattcttctctaggtgagatatgttgatacattgcattggtatgtgtagaatccagtatcagatttaccttggcttccataactccggccttcagagcaatatctacggtccttgaaatcagtaattccaatagatttgcatcctttagtcgcatatggcggaacttagacaatgaactgggatttataaaattaacttcttctggattatatcctagaaaatatttgtaaagcatatccgttcttgtatgtacgatcaaatcccgatcagacaacttaaatttagattttagtaaaatatatttaaacatgacgattggattttctgcaggtcttcccatacaatcactatatttttccttcacttcatcatatataaatccaaaatcaaccatctcattcagtactctccagaaattatctttttcaatcaatatatcaaacaattcgctatatgggcttaaagtcatactgtcttatttacttttcctaacatcatactcaccttttctttgcatctatattatatcattctaatgcctatatttgcgtatttacatatataaaaagagaactgaattttacatcaatcctcttaagactttttcaacaacctcatcacattcctttttatctttccagctaaaacgtattctttgctgctcctaatacatctcttttccatcttgcctgtgtggatatcatgagcagtatgaagaagagtagagcaatcaagataatcatgagcacctgttatgattttatacccatgattttatttgttaaacacttcaagagcttcaactgtgaaaaagtgtgaaagaaaagcaaaaatatagtaattcaggatgattgagacaactttcatggaatatttgtgcccgcgcgcgaagtgtggggaatggaaggaaagatgaacatatttctaagatgacttgaataatcatcgtagttcatctggtatctagatgaactaccttcaatgtaacctgagtttcagtaatgtcttatttgaaaatgtttcatacagtattattgtactgcatataaaaaggtatagatacgtcgcaaagtctatgtttgcctctgggatgtaaatatacctgtatctttttctggcgcagcagaaaggatttgaacctccggtgtcaatgacacgccggttttcgaaaccggtgcattaaaccaaactctgccactgctgcatatctattgaagattatataacagaatacaggcctttttcaagactatttgtaaaatcattctgctttatgtgatatttcattctatattctttttaaaatgataagaaaaaacatgcagtatggtatagcaccacgactacatgtttttttatgttattcctgtacttcaacagcagtctgttccaaggtggtatcctcaccgtccatgatctgctgaaccatttcactggtcagacgttccggaccggcaggtacatacgccataaagttgtcatcgtcttccttatggttacgctcctcacggatttcctttagttcttttgccttttctccaatgatcaaattcattggacgctcatcacctacaccggttccggcaggaatcagcttaccgatgataacgttctctttcagaccgatcaggtaatcctttttacccttgattgcagcatccgtcagaacctttgtggtttcctggaaggatgcggcagacaggaaggaatctgtttcgacagatgccttggaaatacccagcaataccggtttgaaggtagccggtatctgaccgctcagcagtgccttacggttgatcttcgtaatttccgtcagggaaatctgaacaccagggttcaggtgtgtatcgttaccttccagtacgacaaccttgcgaagcatctgacgaatcataacctcaacgtgcttgtcactgatttcaataccctgactctgataaaccttcttgacttccttcagaatgtagttctgtacctgacgtacaccggcaaccttcaacagctccttcggatcaacctgaccctcggtaatcttgtcaccggcttccacatgtgctcccaccttcatccaaggacgaattgcctggatcagggtaaccttgtggacaatgctttctttatcattggatacggtaacctcatatcctgtatcaatctgatgaacatcggtgatttcacctgtgatctgtgccagtacggcaacacccttcggacaacgagcctcaaacagctcctcgacacgaggaagaccctgtgtgatatctccaccgtcggcacttgccacaccaccggtatggaaggtacgcatggtcagctgcgtacctggctcaccgatagactgggcagccatgattccgacagcttctccgacttcaacatccttgccggtcgccatgttgcgtccgtaacatttcttacatacaccatagatggatttacaagtaaacgcactacggatatacattccctcaacaccggcatccacaaccttctgtgcaagtgcatcggtaataaattcatcactttccagaatgacctctccggtcttcggatctgtgatttcctgcttgctgtaacgtcctaccagacggtcaaacagactctcgatgatcgtatttgtcttacggtcaacgattgcttccacccagtagcccttatccgttccacagtcctcctgcttaacgataacatcctgtgctacatcaaccagacgacgtgtcagatatccagactcggctgttttcagggcggtatcggtcagacctttacgcacaccgtgtgtggagataaagaattcggacacattcagaccctcacggaaacaggagtagatcggaacctctatgatggtaggaacatattcacccttggcagatttggactggtttggctttgccatcagaccacgcataccagccagctgtgtaaagttggaggtattaccacgggcaccggaacgcgccatcatactgattggatttttacgaggaaggtttcccagcagctcctcggcgatatcatccttgacatccgcccacagcttattcagatgacgctcccactccatcatggtaagcttaccctttttacgcagtgttttcagctcttcggccttctgtttaccatattccacatgctcttccttgtgaggtgcgacctcgatatcggacagggatacggtaacaccggcaacggtggaatactggaatcccatatccttgatctggtcaaggatctcacttgttttctctgtggaatagcgtttaaagatttcaccgatgattttaccgaggtccttctttttgaaagccgcggttaccggcatggacttgattgcctccttcacgtcttttcccatctccaggaagaaacgctccggtgttgcgacaaagttttccgcactgacttcgttcaggaacgggaagtcggttgggaacatattgttgaagattaccttaccaacggtcgtcagcaggtatttcttattttgttcttctgtaaagctttctttctttaatgcacgtgcaggaattgcaatacgggagtgcagatgaatctgctgtgtctgatatgccatcaggatttcattgatgctgccaaacacatgtccctcattatcaccatagcgggtccagatcgcagcggatttcgggcagtcaaccgcattatagcgatcagcctcctgatagaattcctctgcggtttcctccatcgtcagatagaagttccccatgaccatgtcctgaccaggtgtaacgattggctttccatcctttggaccaaggatgttgttgctaccaagcatcatgacgagtgcttcggctcttgcttcttcactcaacggtacgtgaacagccatctggtcaccgtcaaagtcggcgttgaaggcagtacataccagtggatgcagacgcatggcacgtccttccaccagcttcggtttgaaggcctggatacccagacggtgcagtgtaggcgcacggttcatcagaaccggatagccgtcaatgacactttccacaatatcccagatacgtggatcctgacgatcgatcagcttctccgcagtttttggattgcttgcgatttctttatttacgatttcattgatgacaaacggcttgaacagctgaattgccatttcacgaggcagaccgcactgatacattttcaaatccggtccgaccgcgataacagaacgaccggagaagtcaacacgcttaccgagcaggttctgacggaaacgtccctgttttccctttaaggaatgtgacagagattttaatgcacgtccaccggctccggtgatcggtttggaacgacgtccgttatcaatcagcgcatccaccgcttcctgcagcattcgcttctcattctgtacgatgatagccggggttcccagctccagcagctttttcagacggttgttacgtgtgatgacacggcgatacagatcattcagatcacttgtcgcaaaacgtccgccgtccagctgcagcatcggacgcagatcaggcgggattaccggaattaccgtcattaccatccattccggcttattgtcggagttacggaaggcttctacggtatccagacgcttgatcagttttttacgcttttcaccctgtgcagactccagtgcatcctgaatatgcttgaattcagcctccaggtcaacctctgtcagcagcgtcagcgcagcctcggcaccagtctgggcagtaaagctgcccggaccgtaaattgccatattttcgcggtactcacgttcagagagcacctgcttgtattccagctttgtatccttaggatctgttacaatccaggacacgaagtacacaacctcttccagctgcttcggtgttacatccagcagcagtgccatacggcttggtataccgcgcagataccagatgtgcgcaaccggagccgcaagctcaatgtgtcccatacgttcacgacgaacgctggattttgtaatttctacaccacagcggtcacagacaacccccttgtagcgtaccttcttatattttccacagtaacattcccagtccttgctcggtccgaaaattctttcacagaacaatccatctctttcaggcttctgagaacggtagttgatcgtctctggtttctttacttcaccatgactccattcgtggattctatcaggtgaagccaggcttacctgaattgaggcaaaattattaacactcatttacttacgcctcctcttcgttttcatcatcgctcagctcaatgtcttcatcttctatgaagtcatcagcctctgcatcgtcatccagaagaatttcatcttcggattcgtcatctgcgacagcatcttcctcttctacttccagatcattgatgtcttcctcaccgacaggctcagcggcaggaatcggaggcagagttgcagctgcttcgctgttatcctccttgctgatatctacttcgttaccgtcttcatccagcatcttcacgtcaatggcaagagcctgcagctcgtgcttcaatacgcggaaggattccgggatacccggttccggaatatcttttcccttgatgattgcttcataggtctttgtacgaccaacgatatcatcggatttcactgtcaggatttcctgcagtgtatgagcggcaccataagcctccagtgcccagacctccatctcaccgaatctctgaccaccgttttgtgccttaccacccaacggctgctgagttaccagagagtatggtccggttgcacgggcatgcagcttatcgtcaaccatgtgggccagcttgatcatgtacatgacgccgacggaaatacgttcatcaaacggttccccggtacggccgtcatatagtacctgttttccatccacggtcatttccgcttccttcatgatatcgctcagctcggtgttgttgataccatcgaataccggtgtggagaatttcacacccagcttcttggcagcatatcccagatggatttccagtacctgaccgatgttcatacgggaaggcacaccaaacgggttcagcatgatatcaaccggtgttccatccggcatgtaaggcatatcttctacaggaagaatcttggagatgacacccttgttaccgtgacgtccggccattttgtcaccctcagaaatcttacgtttctgaacgatgtatacttttactgtttcattgactccaggcggcagatcgtgtccttcgcttcttttgaagacgcggatggagtgaacgattccggcaccaccatgcggtaccttcaaagagttgtcacgtacctcacgtgatttctcaccgaatatagccagcagcagtttttcctcaggagagatttcgctctgccccttcggcgttaccttaccgaccagaatatcgccttccataacctctgcaccgaccatgatgataccacggctgtccagattacggcatgcgttttcactcacgttaggaatatcgcgggtgatttcttcaggccccagctttgtttcacggcagtcaatgtcgtattcttcgatatgaatggaggtatacacatcatcgcgaaccagacgttcactcatgatgatggcatcctcgtagttatatccgtaccatgtcatataggcgatggttacgttttgtccaagtgccagctcgccgcgttccatggatggaccatcggcaaggatatcacccttctcgatacgttctcccttggaaatgatcgggctctggttgatgttggttccgttgttggaacgctggaatttacgcagacggtattctctgcggtttccatcgttttcgctgacgatgattctctgggagtcaacatactccacgacaccgttttctcttgcgacgataccgacaccggagtcctttgcaattttgaactctacaccggttccgacatacggagaatgcggctgcagcagaggaacggcctgacgctgcatgttcgcacccatgagggcacgggaagcatcatcgttttccaggaacggtacacaggcagtcgcaacggatacgatctgtttcggagaaacgtcggtcagctctacctcttcacgtcttgcgatgatggtatctccggctttacgtgctacgacatgctcgttgatcagacggccttccacaacctcgttggcctgtgcgattacataatcggcttcttcatccgcagacaggtaaagtgcctcttcctgtacagttccatccgcatttacgatacggtacggagtctgaatgaagccgtattcattgatttttccatacgttgtcagattggaaatcagaccgatgtttggaccttccggtgtctcgatcggacagatacgcccatagtgagagctgtgaacgtcacgaacctcgtagctcgcacggtcacgggtgataccaccaggacccaatgcggaaatacgacgcttgtttgtcagctcagcaagcggattctgctgatccatgaactgagacagctgagaagaagagaagaactccttgattgccgctgtcagcggacggatattggtcagcttcttcggcgtcagagtcgcgatatccgcaatggacatacgttccttaaccacacgctccatacggcttaaaccgatacggaactgattctgaatcagctctccgacggaacggatacgacggttacccagcatatcgatatcatcggtatctccaacaccttccatattgttcagattgtaggcatagaatgcatacatatcggaaatagtaatggtgtgcttgtcagcatacgggtcatttcccataaccttcacaactgcaccgtcgtggtcacggatcaggatttcctgaatcgcagccccgaccagccatgcatataatacagcaccgttgttaacttttgctttgatttcatctacggcagtcacactgagtgcttccggcttgtggcgaggagtatagccatccacgaagaaatcgccttcctcgttgactacatcttctccatttgcgtccgtcaaacgggcaaacgcgtacattctctgtccgtagttcaatacggcattcacattagcgcttgttaaagcaaccttcttggcgatgataccgccatgtacagctaccttttccacacccttgacgattgcttccacatcctgctcactcagaatgcttccttcatacagcgtaccgtcttccagctccacatcgcccgccagaacacgtccgacaagaccaaggtgattgctgctaggtacatataccttatccggatgattgaacagcggattgaacgggaatgcattgacatgcatacctttttccagctctttgcgaagtgcatttcgctcatcgcggttgaccatcgtaccacttggcatgaagacagatccatccgcatccagaatatcctgcgcaagatggtgcttatcaacacggttgatcgcgtttagctttttacgcagcttataacgtccggcctttgtcagatcgtaacggcgcggatcgaagaacttcgcattcattaacgtaatggaaccatccagtgtagggatttcatcagaacgctggttttcgtaaatggacagtaacgcctcctgtgttgtcttgaccttatctgccatcagcgtgttttcaatttcctcgtatttgccgaagaaggatgcatataatgtaaggtacagattcatgaactcgcgatcttcatcatcaatcgctacattttccacgatatctcttcccatagccttcaggaaagttttgatctgcatcgtgtcatgtgcatcctcacttctgtccagatccacagacataccgattgctttgaacagaatagaagacagcattttacgtttccggtcaatgctcatgtttaaaacacgtcctgtagacgcctttttcacttctgtcagaaactccagccatgttccacggcttggaatcaattcgcaggcaaaggattccttccctgttttttcctcataaccagtggaaaagtacgcacccggggaacgcacaatctgcgaaacgatgacacgctccgcaccattgataataaaggtaccggtttccgtcatcagcgggaagtccccaaggaagacatcctcccacttgttgataacctcaccagtggtgttatctgtaatttcaagctccatacgggctttcaaaggtgccgcgaaattacattcgcgatacattgattcctccgcattgaatttcggctctccgaattcatagccggcgaatttcagcttgatatttcctccatagttttgaatcgggtaaatctcattgaaaacttccccaattccttcgttcttgaaccactcgaaggagtctgtctggatttctaccagatttggcagttccagatgcccgcttacttttgagtagtctcgacgctctgcctttttaccggaagcgacaatacgataaggctgttttttgtccatgtacgccatcctttctacaagtttcacctatcaaaataaggcataaaaacccattttaatattttagtattatgcaatttattataatatcaactgtttgtcaaattgtcaatgctttttttgcttttagtatgaaatatcctttttccttgtgaatgatatcgcaatttccaaacacttcttttattttcgtcacggcgctgcgtgctccctgctgtttgcgaatcacaacccaaagtgtcccctggtccgcaaggtgattccatgcctcctcaaagatgttatagatgacgtttttaccggcacgaatcggaggatttgttatgatatcagtaaaagtattcccacttacctgctcatatacatcggatacatgaatgtttgcctcgatattatttttttcagcattatccctggcaagctccaccgccctgggattgacatccaccatttcaacctgtttatccggccatgcctttttggtaacgattcccacaacgccatagccgcagcccatgtcaagaagttgatttcccagctcttcctcatgctcatgcagcgtgttgagcagtacccgtgtaccaaaatcgacactgtctttggagaacacaccgttatcggtaataaaagaaacgttaaaacaccaaaaccggaaagatatttccttccggttttctgctaaatgacgattatctgtaaagtaatgatccatcgttatcccgcctttttaggtgacaaaaagcctctcggctttttgttgtttgtaaaatgtgtaagtatgaattacttgatttctacagaagcaccagcgtccatcagtttcttcttgatttcttctgcttcttccggtttgatgttttccttaattacacttggtgccttgtcaaccagacccttagcgtcaaccagacctaaaccagtgatttcacgtactgccttgatgacagcaacctttgttccaccgatgtcagtcagagttactgttacttcgctaggtcctgcagcagcagcgtcgtctgctacagcagctacagcaactggtgcagctgctgttacaccgaatttttcttcgattgcttttactaattcgttaagttctaagatggtagcttcttctaagtaagctaagatatcttcctgtgctaattttgccattttcattttcctcctgtaagtttattcctgtggagctgcttcttcagcagaacctccgtcttttgcgtcagccactgccttaacagcacatgcaaatccacgtactggagactgcagacagcttaacagcattgataacataccttcacggttcggcagactggacagttccttaatggtatctacaccaacaacttttccttctacgattccgcttttcaataccaagtgttcatgtttcttagcgaattttgccagaacacgcgcaggagcaactgcgtcaccaccgaatgcgatggcgtttggtccgatcagatcctttgtaagatcatccgcacctgcttcaacagcagcacgctgagccagtgagtttttgtaaaccttgaactcaacaccttcttcgcgcagatttctacgtaactcggttacttcggcaacgctaagtccacggtactcaacaacaacagttgactgagattctttcattttctgagcaatttcagaaacgaccgctttcttgctatcgataatcgcctggttcataacttcacacctcctaaatttatatgtaacaatataccctttaagagtgatataaaaacacccgcaggcatagacagactacgggtgaaagtttagtatccaacttttacctcggtaacatgattaagccgtagggccgttactgtctatggtatattgataacatctgatattctaacctgctaacgagattttgtcaatcgttatttttcaacagttactttgacaccaggtcccatggtagtggagattaccaggtttttgatgtaagtaccctttacagccgcaggacgtgcttttgagattaccttcagaagtgcattgaagttgtcaaccagcttctcatcgtcaaagcttacttttccgatcatcaggttgatatttccttctttgtcaacacggtattcaaccttaccctttttgatatcttcaacagcttttgctacatccatggtaactgtaccagtcttagggtttggcattaagccctttggtcccaacagacgtcccagcttaccaagctcacccatcatgttcggagtcgcaacgatgacatcgaagtcgaaccatcccttctggatgtcttccagcagttcttttccaccaacgaaatctgcaccggcatctttcgcttcctgctctttcggcccctgtgtaataacacagaccttctgtgttttaccagtaccgtgtggaagtaccatcgcaccacgaatctgctgatctgcgtgacgaggatccacatttaatttgaagctaacttcaacagatgcgtcgaatttagcgatgtttgtttcttttgctaattttactgcctcggctactgaataagtttttgtgcgatcaacttttttagcagcttctacatattttttaccgaattttgccattttgttttccgcctttcttattcaaaaccttcaacttcaacacccatgtttttagcagtacctgcgacaatacgcatagcagcttccacatcgttggcattcaagtctggcattttgtattctgcgatttcacgcagctgatctactgtgatttttccagagatctctttctggtttcctgaagcttttttgattccagcagcttttttgatcatcatagcagccggagttgttttgattacgaagtcaaagctcttgtcttcgtatgcagtaatgataactggaacgacatcaccggcacgttctttcgtagcatcattgaatgctgtacagaactgcggcatgttgataccggcagaagccagtgcaggtcccggtctagctccccctgcagggaactgaagtttacaaacttttgcaactttcttactcacaagacattcctcctatatttaaaaagtcttatgcagtggtcagaatgaagggttgcctccttctcccacgcatgaaaataccacgaaaccgcggtacttagtattgtaatatgattctattggaattgcaactgtttttttcatgaattacgcaagtaatatccctttctcttttatcgcttcttttgtaatcagaaaaagagatcttttcattcatccaacctgctacagatgaaggaatcaaagattatccgcaggcggctttctatatcagtagcatccacgacagcagaataacgctaactacaaagcccttacagcaggttacggcatacagcaaagcataaggtttctgcaaatgcatagattcattgcattgaatctatgtatatcccatacagaatacagcagattctcctgcatatccatatcattatttctgcaatatcactgccttgcttacgtttattatgaatatccctgatgtttactactatttgttttttagcacgatagattaacagtcttaatttcccttatcacaataaaaagacattcttaccattagacaaccatggtgtacctcatccccttctaccttacagacctgccttttatgacagataccgccctggctttccatcttaaaacatccccttgcagaatgctcagcctgcaacgtgctaaaaacaacttttttgtacctttcatacgatatgtaaacgtttccgctcgtaatttcacagatttcattatataataatatagataatgaaacaaattagatgggagctgacaacatgagcaaaaaatcaaaaatcattaccgggctgggggcagcgtccacacttgcggccgcaaccgatttctttctgtgccggacactgtttgaccagacgctaaaccggaaaaaactgaaaaaggggaagcagctgagtctggcagacgcggatctgaatgatgaacaaaaaacacggcgccacaaggagctgctgctctgtaagaaatggatacagaatgttgcagttgacaaggtatctgtagaaagtgaagacggtctgcagctggttggtatgatttatccttcccatgaccatacatcacaccgctgggcattcgttttgcatgactacgcctgcaccaaggaggatatgcggacagtcgcaagagcctttcatgaacagggctatcatgtgcttaccccggatgcacgcgcacacggagagagcgaaggctctttgatatcacttggctggaatgagcgtaaggatttacttcgctggatcgatgcggttctggaaatggattctcaggcggaaatcgtattgtacggtatttccatgggagcggacacaattctgttctgtccgcaggaaaaactgcctgccgcagtacgctgtatcattgaagacggcggatacacctcggtgtatgatatattatcatggcagatgacgcactattataaaatgcctccattcccgattctggattccatgggtgtccttgtaaaacagaaaatgaacttcggcatccgcaaggcaagcgcattgccgaagatggaaaaggcggttcttccaactctgtttctccatggtgaaaaggatgtgcatgtgccctgtgatatggcatttcgcctatatgatgcctgtcagtccgcgaaggatctctacattgtggaaaacagcggacacagagccaatatgtatgaacagccaaaggcgtattatcagaagattttccacttcctcgatgagcatatgaaataatgcatatggaaggtatccttaagataccttcagaaacaacaaaaaacaatcctgcgtactccttaaacaggattgttttcttctaccttcttttcttatttacgaattggaaaacagatttctgtcacaaattcctttggattgtcacactgcccccagcccttgtgataaatgcagaaattcgctccatccagctcatagccgttttccttgatccacatcgtaatcgccatgcagacctccgtaatctggctgtaatcaccggtaaaagtaacactggcaaccatttcatccttcagctgacgaaagcagatatcctcaacatcctcatagctgccgactacctccgtggcgatttctatatccacattcttttctgcaaatccctcatcaaagaaatatgcccgtgcattttgcggttgtgcaaaggtgatatccagatgcttttccgcaaggatgctgtacatcctcttccataccagatcctcacgctcatatgtgggaatcatgctgcgcagggttgcggcatacattcccttgatttgttttacttctaccgtatacttcataaacgtatcctccgtatcgagcagcttctgcgcccgttccagtcggatcaatgtattcgaaatcctttgccgttcctcttccagctccttcatgcgtatctgaaaataccgctgaatctcctgcggactgtcatactgcgccatgatttcctccatcatggcgacactgaagccggcttctcttagaaaccgtattttggcagcctcgaaaatctgttcatgtgcataaaagcgatatccgctttcctcatccacataacggggcttcaacagattatgcttttcataataccgcagcatccggatactgatcctggacagcttcgaaaaatcaccaatccttaacatgcaaggcacctcgctttctgagctcacaggaagtatacgccatgacacaatgtcagagtcaacccgctgttagaaatactgtacggttcttgtatccagacagacaacccccagtctgctgtgaatatcatttgccgcacacccgcagtcgatatccataatacgtgcagtctttacatcaccggtatctgtccaaatagcataaggatgtgtctcctgaaaaaacagggtaggtgtatgaccgacaatcacactgcggtcatcaaacagacgctcatgtacatccatacggtcccatacaaagcgttccattgtaacatcactgtctttcacatcctgctgtgttacgataccatgcgtaaactgtggctgcgcactgccatgtgttaagtaaaacagttcctcatgcactttaaggtcacagattgcaatcggcagttcatccagataatccagaagctcacgctgcttcctttcattcagacgttcaaaggcatcgatcgtcgggctgcagtgattgcgttgccagcgatcggttaccacccatgcctcctgcatatcggttatcacatggtgcaccgcctcataatactgcttcatcatatattcatgatttcccagcagcatatatacattatctctattcataatatctagaaggatggcaattccatcccttccgcggtcaatcacatcccccagtacaaacagcgtatcctcattctgtaacgcaagtgcctccagcatggcatcgtagcggtccttaaggccatggacatcactcatcacataggtactcaaaaacatccctcctttatgccttaaccagcagttgatttataccacagtatgttaactcttcttccattgcaggaagccctgtcctgctttatactatagttacaggtacctgtagaaagtaaggggtatgcatatatatggatataggtaaaaacatcgttcgtctgcgcaatgaaaagggttatacacaggaaatgctggcatcacttcttcatgtcagctctgcggcagtgagtaaatgggagcacggcagcagctgtcccgatatatctacacttcccattttagcacgaatttttgatatcagtattgatgagctgttgaattttgaaaaaaatctgagcgaggagcaggtgaacaggctatgtgaagaaatgctgggacagtttcaaagtgcacctttccctgaagccatggcatatgtgaaaaaagttttacggcagtatcccaacagtgagagcctgaaattatcgtttgcccgcttatctatgcaggtacttcttctgcttcaggaggaaggtcaggcaaatgagtttctggcactggcaaagcagctggcacaggaggtttcacagtcagcggatttagagaaaaagcagcttgccggcatcctcctggtgaattttctggcaatggaacagcgctatgaggaaggtctgcagctgctgcagaaactgcccagacttgcggatacctcttctctggaaggtacgcttgccatgcagatcaaggatgaagacgaggctatgcatatgctgcaggctcagctgttttcccactatcatcagataggcatgatcctgttaaatatgtgtaatctggcaaagcgcaacaaccgtatggatatgttaagaagctatctgcagctgatggaaggcttaagccacctgtttcagctccctctctcggtaatgtctcagctgtatatctacagtgcggcactgcatgatgaagcagccactcttcgctatgtaaaggaatatatcgagcagttgaaatcaatggacaatctacagaagcagcggcagatgcagctacatgacattccctggtttgatcatgtagagctgaacgctcaggggctttccaagggaatcatgcagacgcacataaaagatatgttagaggatatggcacagtcttccatcttatcatttgacagtgtacagcagctactgaaagaggaaatcgccttgttaaggaaagaatagatgcaggaaaatacagaggattccagataaaaagaacagagcgctcacatatggttctgttctttttgcctttctcccgtatacgtatatagatgttttcgtactgtaccttacagcaattcggtatgcaggcagagctgctccagcagctgctctttcttttcctcatccttgagctgtgcaaaaacctcatcctccacactgcgaatccagtatacatgtacgccttccttttttaaatgcagaggtaacggatccccgcttttttcatcatcgatcagcacacagccatacttatctttgattgggatatccagtgtatgcccatgtccgacacagtcaatcgcatgccatggaagtgaacacaggccggcaatcgaggagaacagctccatttcctcttccctgctcaacaaactgctcgggtattgaactgcgtattcacatcgggcgtagtcttcatactccgcataataacggtctgcattcggcatggaaaacataccggcaccaatggtaaaggcatacgacatcccatccttttcaaaggttaacagcagtctgcttggaaaacggtccttgtttaagtcatagcagttggtagcagccccgaacaaatcactgagctgtgagaaataaggagtgttataggttttccacacctcattaaattcctgtttccagaaagccttcccttccagtatccgttccaccatgggactggcatccttcagcttccacgcaaccatattgttttccttcgcatacagcgcatagccgggaaagttatgaccgtctgcccaggatggtatgacgcagacgatttcatcgttatgcagtaaaccggcgatatgtccttccttactccagacaatttccagctcagcctcattccacggctttatatccatatcctcatccacaaacatacttggcagtaccggctgatgatcctcttcgattttatctttctgaaaggtaagaggtgcctccaccagatttttcacccagcaggcagagcgggcaatcagccgttcattttcaaaatccagatcatacatataaaaataaatactttctccatcactgatgacatcagccgcaatcggacacagcggtgattctgaaaacttcaggcttgtttcttttatttgttccatgcatttctccttttattcgtatggcaatattatacaggaaaagcgagtaaatagcacggattggaaacctttttcctatatttaaaccgattttacataccgtatcgcatctcttttagtccgtatataaaaaataaagatgcaaacataaaagcctcgcattcacggaggtaaagatacatttccatgagtggaggctttcttattatttcaattccttaatcgtcttaatgccctcggcatcgatataggatatgctcagcttatcgccgctttttaagaagacaagctggttttcatatttcgtcgtaaagctgattttgtagatatcgcccttttccgattgaatatagtaaatcgtattaccgtccatgttgattttttccactccggcaaccgtgatatcttctgtttttaaggactccttactgatactgtcctcactgccgcttcctaaaagattcagtgtctttttaaacagtgcatccagaccttcatccgtatatacagtagccaccttctgataatccacagcagaaaccgtcgcatacatcttaatcagaccgttatcctttaacgacatcagatataccggattccccttaatattgatcagtaacgggaaggtggactgataaccgtagtttttcacctcagactgcgcactcttcatcgcgctcttttcattggcgcccgccgtagcgattttcatggcttcatgtgtacgcagatttaccagtacaaagcccagattggattcatccgcattcgccgaggtcagtccgctatacagccagatatcgccgtttttctccagatagttatagccctcggaggttacaatgacaccggtctgtccaaactgggagttccagaaccccttcttcagactgccattgtcatccagctcctccacgaccagagattccggataaatgcggtctgcccaggatggaatatgcttggtgtcatatttctcactcttaccggtaatcggatccagaaacacagctccggtgacacgtttcttatttccaacgccggaatacgtgtaggttgtacaaatgtaccatggtcttccttcctcatcaatttcaaaggatggctctccgaaaatttcagtcggatactggaaacgcaaatgacggctcaggttttcattgaaatacgcagatggaacatacttcataccatccattccgagatccttcagctttaccagctttgttttcccactggtgctgtccaccgtgatataggcaggcaccccgccgctcttgtttttaaagtatttgataaatccgttataggttaacggtgtcacacgatacacactgtccttataggaaatctgtgtatactcattgctgacatcaaactgcgaaacccattcggtcatgtttcccataaccttatctcccagacggatggagctgtcacggtcaataatcggtgtctttttgaaatccacctgcggaacctcgctgaattccacatcctttggttcaattctctgtgagaatgcctttgcatggaaaatgcgtgaagtaaccagagtagctgcggatggaaagacaaccacaaacatcagtgccagaatggaagccttgcagattgttccccagcgcttctgttcactggtcaggttaacggcattcttgttatgaaaggatgaacgccagttctgaaaggaatcgatctgacgcttggtaaaggaaaacacaatcagcagcaccagaagcggtcctgcactcagtgccagaaacttccagaaagccggtgcatgccagttcaatggtggcagcatcacataaaacattccgaatatgtacagtgcatatacaggaatcagaaaatatatatatttcttcattgcttatccctcgcttttgaatttgttataaatatatcatattccggcctgttcgtacactgttttccatataagtttgtctttcaaacaactacgttagctctatgctgtgcaaacatatctgttaccagttaagtccattgaccttgtttatgaataaaggtcccccccttcctcatatccacaggggtgcaatcaatcacgtataggatatatatcctcatttcagcttattccagctacagctaagccttgcatcctctttcatggacagcatgttccttttcatgctttatagcttctaaattctgtgataagagcgggaacgatagatgcgcagggttgcatagcaaagcagaaaactgcagggaatccatacaagaggaagcagcttccagaggaaaaaggcctgatcaaacagattgcaggtgaagcctctgactgcgacacatgtaagttccataaatttaaagggaaacagcttcatccacgatgcgtaggaggacagagcagtacctgcaagcatacacagcatgcagagtccaagagatacataggaggatttcagacaggtggaggcaagtgttcccagaattgcacagaccacagctcccagtacaaggacctccattgatatgaagaatccctcctgataggtaaatacagaaatcatatgcagaccctcggttatatttactgccatatcaccaagatttccggacagccacgcatacagtgttaccggcagaatcatcagcagcaagccgatcagtgcacaggttatcacagcggccagcttggacaagaataaagcgctgccgcctctgctgcaggagctgagcacctccagcatattctgtttacgctccctgttgatcacactgctggatatcaccagtacccacaccataagcacgatgcctactgtggagtaggtttccagtaaggaaaaccattctctgctgtctccataatgaaaggatttcttttcattcatgtaatccttcagcagctgaagctcagccctgctcacatcaagggaatataccggggctgcgaccttttcattattaaatgagctgtacatcgtcccaaaggtgccatcctcactgttccatggcttatccgctagcatagtctttccataattcaaatatagcatgctgaccacctcatctgcgatatcctctttataatttggtagaaactcctcgcgcagatagagaatccgctttcctttttttgcttcctttgtatcatccgcataggcgtaatctcttttattgctttgataatcctcataccagtctttcccatacagtgcattcattttctccatgttgaaaaaatgcgtatctatgcgtttatctgccgctttttttgccaccttcaaacggttccaccacgctgcatccatggtaccggtccattttaatttttcatgatgcacttcctcctgaatttcttccttgctcatcctgcttccatccgcatgccgataaggattcgtattttctccggtatccgtaattctattctgaaaaatgaccattggaagcatcataaacagcagtaaaagaatcagatgaaagcgggaggtcattatttttttacattccagcaaatacagtctcatgcctcttcctcctgaaaatgatataaatacaaatcgttcagggtcggctccacactgcaggcatccctgcctgtttcatccagatagcggacaagtgttccctgtgttgatgcacgctgatagcatataacggcatgcccacgcagctgctccagctctttttgtgatacctgacgctccttcaccctgccgtccagcatcgaaagaagcttttgcggtgtatcatgggcaatcagacacccctttttcatgatcataatctgatcggctatggcttccacatcactgacaatatgtgttgacagtaaaatgattttatccttggacatctcgcttaaaagctgggaaaactggtttcgttcctttggatccagccctgcggtcggttcatcgagaatcaggacagcaggatcgttcaggagtgcctgtgcaatgccaaggcgctgccgcatgccgccggaaagcgtccgaatcttctttttccgctgtggctccaggtgaactgcaggaagaagctcctgtatacgctgcgtcgtataggacttcgtcaagcccttgacagcccccatatactgaaggaattcctcaacccgaaaggttggatacatacccagatgctgcggcatatagccgatattggcaagatattcctcccgtttttcccgtatgtcaatatcaccgtataggatatgtccctcatccggaggcagtacgttgaccatcatgcgcagcagtgtggtttttccgctgccattcgctcccagaagaccggtgattcccggctttaatacggcattcatatgttgaaccgcaatgacgcttccaaagtgcttggacagctgttccagttttacattcatataaatctcctatctcttgctgaatacaagtatataattttctgcatgtttcatttgccggatcacttcatttctgttctttccctcactccaccttcatcgcggaagctgtacagacttctatgattagcctatgaacggatattatgatcggtatggttcggtttccgttttgtactcttccccaatgtactcatcatgcgcatgatcgaccatgaacggatgctgctgtgttttgcaatcataaccggaatcagcacgatacacagaaagctccatacaacggacaacaggggcagacgatgatagaggtttcccaaaacagcaagccatggcgttgtcataagctgatcaattgcccgaaaggaaaggaaattggatggaaaaaatgatgtccacgaggtttgcagaccatccatcgctatcagcatcggcaatagaaaaaagagcatgccaagtcccagcgaaactgccggtttttttactatgacggaggtgaagacagcaaacagagtacacgctattccactcagcagcaacaatccaagcgcctgcaaatcaatctgtgaaaatgtatagatatgcagtgttctcagcatcatgagtgtcgtatccccaccggataagtccaggatcatggaggttgatacagacagtatgatatacagcgcggccgccagcatgagtgccagtgaaaaagagacaatcagtttggcacaggcaagcttccttctcccctttcggcagcttttcaacagctccagcatatcgcaggattcctcctgattaaacatgcttccaaacagaaacaggcagaagagtgcatacagcttggcagtgtcctcaaatatcttcatgcggctcatccagccctcgtatggaccatagcgccattggtgtgtgttcaaatcatgtcgtacgatagcaggtgtctgcgggtccaatcgtatggcatccaccatttccatggtacgatagccgtcccagtatgcctgatccagtgtttgatagcgaatatcctctttctggattccctgctcgacaagcttttccagctcctgctttcgatcggcaatccagctcttctgcactgtcccggacatgcttctgcgcagatcgtccgctatggcttttgcttcttttgcgttcaataccttatcattgagcaaggcgtagcgctcctgtgtctgcgcatgcagcgtaaaagcaagatgcagaagcggaaacagcagcaggacacacagcagggcacaatgcagccgggagtggaaaaatttatgcagctcacgcagacacagtctacacatgaagattcctcctgcaatgatcccacaggacataaccgctgtataccagaacagcaagaaacagctgcccgccatattgttccagaaaaccgatccaatatcccactccaaacagctccagcaggacaagaccacctgccgcaaagccgtataccgtcagaaacacctgcaaaacctgatcatgggcatataggtgtaaggtaaaggcattcagcagcaaaaacggaatacagccgctatacagcagcgtaagcagatgaatatccgtttgcagggagatgctgactgcgataatcagaatacccagaaaggagatcccccccagcagaagcattttccacataagcatacgctgcggcgaataaggcgacgccatttccagctccttcataccatagatatcacatcggaaaacctctactgtaacagcaacagacaacagagagcttccaagtgaaagaaaggctacagaattcattttatatccatttggcagacacagccatacagctagtgccacaagcagtgtcagtcccccctgtaatacaatacttttccaaccatgtacatacagcagctcacgcagacttttcagtatactgctttcatattttttcacagcacgcttttgtagcagttcctttacgtttgtgataacctccacaatatcgtcctccggtatgtccggtatttccagcgtttccaggcgaatcctttcttttttcacttccatccctccttctgagcacgttttttcaatatatggagtgccagccttacctgcgatttcacagtggaaacatgaattcccgtaacctgtgagatatcccggtatttcagtccttcatcataccgcagcagaagcacatcctgcaaatgcggaggccgctcgcttatccatgaacgaagaattacaaattcctccttcttctgaaacagccgctcaccattatacgtatcatcgcgcatctgctcctcctgcagctcgtccgtataccgtctggagcgggtatggtcatacaccaaatgcctagcaatacggtatagaaaattcagcagctttccctgttcctcatattgatccagatgtctgtaaaaccggtaaaaggtttcctgtgtcagatccttggacagtgccgcatccagtgttcgatgatataggtaggaatacactttcggataggcatcccgtatggctgtttccagctctgcttccttagaaacagcatgtttatttattttcatctgcatgacgcccctcctcattctgtataacgcagtgaattgtgaaaagatgaaagaaaatcaattttcttcaactcattataaatgataccagattcattcatttctatatgatataacattatagtttaaggcatttgaagcaaaaaatgatgtccatggttatttaaagaaagatgacaaggcagtaagcgtttgtcatcttcgtaaattcattcatttttcaattttcttgtctatcaaacattttttaatacagcagccattttatatgattctgatagttttctttttcaccgaaaagagtataaaacatgttcccatcaatcagttttatcaaaagaaaaggcagcaattgaacccgttaaattcaaaagccgccaaggttgcatgtaccgctaaactagctaaaatcatttacggtatgtgcaagaacaacactatctttcaaagatagccaatttatattatacatatttctcaaaaaaatggaagattccatctttttgtcgcagacaagtgatctgctggtaatgaagtattattttctgaaatttaagcttgatttctattatctaatttcgtatatcagaaggatatagcagcagctagtcgcttatatgtaaaataccgcttttctgagttactgacttatcgtaatattctgttcaggttctgcatgagggcaggataatccgcacggctgaaatcggtaacatcaagctctagcaccgtacccaatgcaaaggttccatacccacggttcttacaccggttcatgaattcctcataaccgaccatacagggctgctcatccctgctctgaagtatatctcccttgtgaaagctgccggcaatatgtcccgggtggcgtgtatcatccagatcacgtgctctttggcgttcatacaagatgtctaaatctgccacaagccgtatggtcacaatctgataggcgtgtgtggctgccaattgtcccagtctgcttttttgtttatcactgaagggataatcgctcagaatggatatatccatctgcatcatatcctccatatccttgtaatattccatccaagccttttgtatatcggcttctttttcctccatcgtatcaaaaccgtaacgatcccacatttcttctttataggcatccggggaaaggatttggaatgttggatatgcttcctgaatctgacgcatcagataggattttccggtacccggatagcctgccagcaatacgagtgtctttttcactttacagcttctcctttgtttgttttcatcaggtgttatctgattctgttatacaaatgcccatcgtttcgtgggcaaatagattacattttaaacaatgtggatttttctgtgatgatacgtttgatatgatcatttgccggtgtaaacagctttcgtaaagatgttaacggtgttgcatccgggaagctggcattcacttcttcaatataagatttatttaattccgtgccgacattgattttcttcataccctttgcacatcgcttcatatcctcatcactgacaccggtaccgccatgcagcaccagtccgacatccggcagcttatcctgtaaggtttccagcagctcataatttatgtttgctttggatttatactgtccatgagtagttccgattgcgactgccaaagcatccacgttcgtttcctttacaaaacggattgcatccgcaggcttagtgtaggcggcatcgcttttttccacaacaataccatcctctgctcctccaatgcttccgatttccccttccacagatacattgcgctcatgggcgtaggcaacgacctcctgtgtgtttttgatattctcctccagcggcagatcactgccgtcatacataacactggaatatcccagatcaattgctttttttaacgcttctatggatttgcagtgatccatatgcagacatacgttgatatccgctttctttgccaatgctttgacagcagcaatcagtgcctcaaagccaatatattccgcagtccccagagacgtctgaataatgatgggtgttcccaattcctgtgcggccgcaatcattgccggcagcatttcaaagcagtgcagattgaaggctcccacagctccctttccttcattttccctaaacatttctatcagattcttatacattccaagctcctccttgtttttgttataccgtttccggttttaaaagctggctctcgtgacttccttggaaatcgccatcatttcatcaatcttacgaagataatactgaatctgttcatcatcctttgcctttgcggcctctcttcgtttggtattatacagattcagcagtgcacgataacccttccccagatccttcttttccgaaagactcatttccagatatgtgatagcttcatcagtctgttttgcttccgcatacaggattcctatttcgtttaatgccgcaatgcgttcctctccactcttatccttaagctctgcaacagctcgttgtgcgtttgccagcagctcaccagtatcctgtaccacctcttcctgtacaggctcctctttcttttctttgcgtttaaagaacatatacaagctcctaaaacaagccgagaaccggttttaacagccagccatacagcagcccgcatacgatggtatccacatctgtacaggtcgcattcaggaatccgatatctgccagcatcggtgacaggattgcaggcaggagtgtgataaacaagccgtgaatgatgccggagataatgcaacctctggtacctcccatcgcatttccgaagattccggcacagcctccggcaaagaagttggtcatcattcccggaaggatcatcggaagaccgaacatcgggaagagaaacatgccgataacagaaccgatcgtcgtactcacaaagccgataataactgcgttaggtgcatatgggaacaagaccggacagtccagtgcaggctttgcatccggaaccagcttcatagcaataccacggaacgcaggaacgatttctgccagtaacagacggacaccggctagcaatacatatacacctacgacaaattgaactgcctgcaggaaggcgtgtaccagataatttgttgcccctgcatattccgcacagaactcaggtcccgcaaagaaagccgttaccagaaacagcggaatcatgacgataccgatagacaagtaggtatcctgtaaaaattccagacccttcggcagctgcagctcctctgtggaaactgatttcttaccaccggtcagcttacctacccatgcagttaatacatagcctacagtacagaaatgcccgagtgcgatatcatcattgccggtaatttttctaacataaggctgtgcaatcgcaggcatggcaacagcgaagattccaccaatcagtccaccgacaagaattagcgttaccccgcgcagtccgcaccagtatccgaagacagcgcagatcgttgacatccagagcagcgcctgtcctgtcagaaagatatatttccattttgtaaagcgcgcaatgatgatattgaagatgaaaattgcccccagtgtcagtgcgatttcactccccagaccaagctcccccattgcctgtccgttaatcgcttcgatggagggcaccagcccctgcatgccaaagccttcggtaaagattgccccaaagtaggtaagtgcctgcacaatcacgctggagcctgccgatagcaccatgaagccaagcagtgttttgaaggttcccgagatcacctgtccggttggttttttctgcagcagcaatcccagcatcgcaatcaatgcgatggtgatcggtgcctgtgtcagaatgttgtcaatgataaaatttacaatttgcatagtagttcccttcctctcttgtttttaaaatttaaagtttgccctgttccttcaggaatggtacaatcttttccctgatttcatttttgtccaccagacggttcaaaaagatggtcggtgtcgtcagctccagatttgcgaactggctctcaaagtttttacccgaaagaatcagatccgccttcattcccttcacactggatagatcacaatgatccagcgaggcactgacaccaagctcctgaagcacggtttccactgtcatctgacaggcaaagctgcttcccagaccgttaccgcataccattaaaattttcatattttcctccaatcttcacggggttgccgtttctaccttattcttcattctgtaacagggcgttgagctcatcgatcgtatccagctttgcgattttctccacataccccttttccacaaaggtcacaatcattttcaatatgtccagatgtgtctgggaatcaattgcggaaaaacagatcatgacctcaaccggatcatccttggggtcgaagtaaaccggttccctgagtgtaatcagagaaaacccgatgcccagagaaccatcctccgctcttgtatgcggaatggcaaatccctttgatatgacaacatacggtccgtattctttgattgaatttacaataccctccacatagctttcccttgcggttccgttttccaccagaatcctgccgccgatgcggactgcttcctcccagtcccttgcacttacatgcagccttacatttttctcacttaattcaattcctttcataacctcattcctttccctgcctctgatattccaaatcccgtataaactcttcataggtgcagcccttggcaagcctgcgaacaccaaaatcacgtatcagatatttatacagtgttttgaagacatcttcccacatgccgtatttgctcttcggtatatttaacagcaggacaacctgtaccttttcctgatcccagacgatcggtttatccagaatcgttacggatacactggcctccagcatatcattttccagggaatgcggcatggcaaccatactgcccagctcagtcgtcgccatagcctcccgtttgaatacggattgtttgttttcctccttcatataccccttttcaatcatagcatcggtaataaaatgcagtacctcatctcttgttttcagcttcagatttgtgaaatacagatcctcccgaaagatttccttgaaatatccgctgtcctcatggtgatgcgtcatgaaggtttcaatattgcggacatcccgttcatccagcaataattgtgtttgcaggattttttcactgtggaatgcctccacaggcacacttgtcagtacgaggtccacactgtcaatcagtgcctgtgttacctcatacagcgggcaggttttcacaatatgaatccggttctggaaaaactgtttcactctttccttcatcagcattgcggttgccattccggaggcacatacgatgacagcttcaaagattttctgcttttcattcaggcccttccgctccagtgctgcaccgaaatgaatcgcaagaagaccaatttcattttcatttgtcttaatggagaaaacatgctccacgatttcactcgccttgactgccagctcgaatgcaaagggataattgtttttcatatagtccagaaagtcgttgcgtatattcatatggaatcgaagccgctgaaccgcaacactgaggtgaactgccaaaccattgatcaattgcgtatcatccgaaagatcaacattggtatcctccctgattcgatacagaattgcctgaatttccttcttaaattcatactcctcattttcatccgtaaagtttgtggcaagaaacttcttactggatatcaaatgctgcgtcagatagtacacctcatcggtgatatcaatgtgcagtttatgataaataacagccagaacctcctttgccgccgcaaactccatatgactttccagctgacggatttccgcttcttcataatccacacgccgttcatgaaaggagcgctttaagataatgacaatatgtacgatcaggttcttgaatgcgatatccgtaagacgcatatcatactttttcatggtttccagaaggatttcatgcagctgggaaaagagctcttcactaacgatatcatcaaaaaatcccgtttctctggatgcacgcgcatcgttgtgcttgaaaataaattccgatatgcaataacgaatattggcttcacttccgatgatatgcacacctttctttgtgctgataccgacctttaaggaaaagcgctccagcattttatcaatctgccggatatcctttttcagcgtggacatactgacaaacacctcatccgccaaatcgttgggatcaataatttcttcattgcgcaacgtgttttttaacagatgctgcatgatataggctgccctgtctctgggatcactggggataatcgtatccgcatccttttcttcctcggcatgcaattgatccatgagctctgtgaaagcctctggttgttccgtattcagataatatccactgcctgcttcggaaagaatggttgcaccatgagcatgaaggatgccgttcaattcctttatatcgtttcgaatcgttcttgatgacacgccgatcgataaagcaatttggtcgctgctcaatacctttcggttttgtgtcagcagttccagaatctgaatcatacgtttgttatatagttccaatactgttccctccttgcttatggtcttattataaaagagcattggggggattgataggctatcattttccactatctgcggcaaaaacaggaaatcttttcctaatcactttcctataatagaccaagcagattcatagtgacacaaaacgaaaaaaaatgatatccgttccatcacaactcctgacaaaatgaataccttctcttctttttcttttcatcaatctttcagtttctcctgtcaagacctgcagaatgtttcgctatcctacaaagccctgcaactctttttttatatggaaagagtgaatgatgtagcttctgtttactggtttcttactttccaaaataacagcaaatactgaaattccattatatgcgtatgctatcacacatcactccctgtacaggaagtgctatagcctgccatttcaacgaacgctgcgagtatcatccctgattctttttcaccatctaccggcagataggcttcctttcgtaagcgtccttatataagcttgaagttctattttgaaactcatcatgttattgcttagaaccccttcatcagaaactgtatagtcttatccagcatattgttcactcactgattcatatgaaaaaaaccctgcttatgcatggttctttctaacgttagagtgtttgcaaaagggagacttcagcttctattgttaaccacaatcgtatggaagtctccctatgttaaatttacccacaatcgagaaagaaccttatgtattacaggctttctctatattgcttatgaaagcatccttggcatccttataaaacacttataatgcggcgcggtagatgttttttacatcctctttcgtaagctctacataagctcccttcaaatccgctgcagctttttccgccatgacatcaaagtttgtttcatctttaattcccacttcgcgcatcgttgtcggaattcccatagcaacaaaatagtctttcgtctttttgatggcttcatgcgcaatttcaaacggatccttttccctgtcgatgccccatacattaacgccatagtctttgaatttatccacagtttcctcattcagcacgtattccatccagtgcggcgttaaaatagccagccccacaccatgtgtgatgtcataatatgcagaaagctgatgctccatcggatgcaccgtccattccaccgtttttcccagcttaatgaaattgttgattgcccagctactggtccacatcaggtttgcccgcgcttcataatcctcaggattttgtactgcacgtacaccgaattcaatgcatgtctttaacagtccttccgccatgcgatcctgcatatagccctgtacattggagaaatagcattcgaagatatgactcataatatccgccgtacctgccgcagtctggtatgcggatacactgcaggtatagcttgggtccagaattgatgccttcggccgcatatcctcatgccccgttccgattttatcattggtttccagattactgataacggcaaaggtatccatttcactaccggttgccgacagggtcaaaactgttacgattggaagcacactaactacctttgcaggatttaaaacgatatcccatgcatcgccgtcatagctgacagcaccagcaatcaccttggcgcagtcaatggtactaccaccaccaatcggcactacaacttcaacaccttcctcacggcacagcttcacaccctcgcgcaccgttgtaattctcggattcggctccacgccggacagctcgcaccatgcgatgccgttctctttgaaaatttttacaacatcatcataaataccgttgcgcttgatactgccgccaccataaaccagcaatgccttcctaccatagccggatacaattctgccgatattggctatctgccccttaccaaaataaatttctgtgggaattgagtaaataaagttttccataatcaaaaaccctccttacttttattatacaacgttcacagcaacttgaacatggctgtttttcagtgtttgtcctatgaaaaacagacaaatctcaaaaaggtctttgtacatatatttcccgggaaattcataccatgtggaagcttccatgtgatgtcacatttttccttcaggataccgtatctataatttcacttaagatctgctgtttctctgccgtttttaatatgtccacaaaatcctcatgcatcagtctgcgggcaagctttgacaatgccttgaggtgaaagtcatgtttatcatccggggcaagcaggcagacagctgcttccaccggcttttcatctatggatttccattctattttatgtttcattctgacgaacagaattcctgcttcctttatacaggtatgacgggcatgcgggatggcgattccttttccaaagccggttgtgcattcctgttcccgcttgcacagctcctgaaagaaggtatctgtatcactcacctttccctcacgaaatgcaatttctgcaagtgcatgcagaatttccttttgggtactgccttccatatccaatatgatatgttgctccgtaatcagattcatgttcatttcctccacctgtgcagccatcgatacgaattcctgtctgcatctattcagctatattttacaggaaagcagacagcatggctatatacattggtaaatgtttccttttttctcactaaataagtaccgtggaaatcttccgatttattctttcgactgctgtattacctcctcttcctctaagcggcaagtgcatacagcgcatgatacaaggagctttcccgctcataaatcaccagcacacgctgtgaaatcatttccagcagtcgtatatctttggtttgcgacagcttccacagcagctctgcaacagcatcccataaaaaggaaaccgcaataaactgttctcccagctcaaataaacgcgtatcctgccatataccggcagcttccttcagaaaatcaccatacatcctgcgaaagattccccctccggttccgcctctctcattgatttgaaaatagtttgttattcctgccagcttcagcttttctgcatgaaatgctttccacttattgatttctctggagaatttcagtataccggaaacacccaacagctgagccggtggatgcagcatgcagtcacaggtatccagaatcgcttcccgtaatatttgtttatccacggtgcgatatccctgaaaatcaaaggtcagatacttattctttgcaggaaacggacgaaagctgctgctgcgggcacgcttaatatcctcataatccaccatgtgatagtccttagcaacgagtccgttgggcgtttgtatgggagcatcctgctgatccctgtcactgacgagaaatttgtgctgttcctcatcgtagccaaacagcacaatggcatgtccgccaaaatggctttgcgcatccagtccgagatagggaagaaacggcatatccacataaaccagaacgggttcgccggcatcaatcatttgctttgttgtctgaaatattctctcataattcttaccggcccgacagtgaatggtaatctgtaatctgtctgccagcattttttcaaattcgaataccttggtacgtccgttgatcatgggagaggctgcctgattcagatagagaaaagataatcccgaggccagcccaaacattaactcctctgacatcggatatccgtaatacgtaaagatttgtttcagggaattggtaatgcagtgcttccctccctgcgggacgaaattctccactgtatttttcatctacggttctcctctcttgcaaagggcaaatagatttccgttacataggcatccgggttaccgcgaaacagcattcccggtcccttcacgtaatcctctctggatggtgtcagaatgcgaattccttggtcattcgcataggcaaacaaagccttataggcaatccagagtgtgtcatagccgccatgatgtgttgtatgcagagcatgcagcttctcaagatatctgcaggttagcaagggatggtgtatctcctttttcacgggaatacataattcaatatcggcagcttccttacattcctcatcgtgatacagattgaaatgtttatcgttcgcatttccttttacagctttgtaaagcaacggaatgtacaaatccagatcctggtatctgcctgtaaagcgaatggatgcgatcagttgtcctgcaacggtagccgtattaatcgcatatgtattttccacatattcctcaccctgtgcaaagctatgctcccgcattcgctgaatcagctccctttctttctgtatattagcctccatccggctgattttttcctgcagaatataggagaggtcttcccctctgctattattcagaatatcctttatttccatgatggtaaattcaagggagcgcagatactgaatcatctgtgccgtttttaaatcctcatcactgtaataacggtactggttctctgcttttcgaaaggatggcttcagcattccctccgtgtcataataccgcaatgcttttactgttaaaccgcacaatttggaaaactggctgatggtgtacataatgcttcacctccctctgctttattgtaaacgttcctgtgcacaggagtgtcaagtagataatagcatatttcgcgaattgatattgaaaaacagtatacgattcctttttgttgaaagtgtatactgtttatatgtcttcaaaatgtgcaattacctctgaggcatcccgcatatccagcagccttctgatttccccatgctcaatcaaagcaatcagcctgcggtaaaaattcttgatggagcgttcaacctcatttttattgcttacggatatcaccggcagaaacacatgctgtacgtgctcgtcacgaccccaaggaatggtcttctgcaatccggcatacacgatcactgtatcgttaacatattgcgcattgccgtgtggaatggcaacacctgatccgatctctgttgatatttcgcgttctctttgcatgacagaagagaaaaacggctcctttacataaccagccttcagcagtttttcacaaatctgcttcaaaagctcctccttgttttccaccgactgttcaagaaaaatcagattctcatcgaacatgctatctgcatgcggcagattgttttcactatgcagaatcttcttgtccaatatatgatttacaatggagcgaatgtacaggcaatcctcctcctttaaaatttcatttacatgaatttgaggaaaatcatcatgaagatcaatcgtagcaatcactaaatcccatcttcgatgctgcttcctgctctgatattcctgttcagtcataatatcatcgatccttatggcatgatgcagcttctgaatctgttcccgcaaaatacgaatcacattgtcatagcgctttacaaggaggcagacatgcaaatcgtagtctgtcttttctctaacgacaccaagatataaagctatgtaggcaatttcatcctctgtaatcgtcacgctataatattggtcaaataaaatactggttgcccaggtagcctgatatatggatgaaaagctgctgcgaacctcatgaagcagcggattatgaatccgaacaccgtttttcaaacgtattatcgttcctgcaagatgtgtgagcagtccctccatcaattcctcctcacgatctatgctgatactcaaaatgccatttaatatatccagaaactggtctacaaaggtatgaaaatgctcggtatgctccaaatcctcacgtaccacatcaaacatactatcatctaccagaccgtaaatatcaagatacagctgaatatagcatttttcctgctccggcaaaagaatatgatatattgcttccagtgtttcaaagacctttaaaagtcgattgctgcgctgctttttatgcagcatatccatctgctcctgccgcatgtccacaaaagccttctgctggacacgcagaatacacatgcaaagatgcaggaagacatttaaacgactgatatgatccagatatacatgacagtccttttccagctccaacacacaggtttcaagcggatgatacaaaaatccctgaaacagctcttgaaactgcttgctctgctgctcatccagaatctgtccaaccttcccctttacaaacgggtaatcgcttcgttccatgaacagggcaatgatacaatcacggatatgaaactcatctccctttactaaaatgccatatttctgtcgattgcggatcactatgttataattgcagcagaactcagaaagctcacgcaggtagccgtgaacaacatggcgtcccgcatgcagaacctcacaaaaacgcttttcactccatacgtggtctgcattatgaaagaacagactccttacaatgaatgcctcctcctgatcctgccgggtatgcagcagcatttcgtattgcctgtgtttattcttttgcagctgcagagacactccgctacctcgtttgcgaattaacacaccgatttcctgttcctgaaggatggcttcaattactgttagttctgaaagcatcgtcttttcagacagggaacaggtttcacacagggtgcgtatactgataaaatcatctgcgcgctccagctgctgcaggatatctttctgccttctgctcagcataggtatacctccttttataaaaggggacagactgtcccctttctatgctttcccctcctgatgaaaaatatgcatataatgcttaaccatatccttaaacccttgctgcatccgatggtagaccatatgaggttcacctgcctgcccacccgctttgatagcagctgcaaaattatcggtgccaatattgattttggaaataccgcattgtattgctttctgcaggtttgcatcaccgcttccactgccgccatgcaggaccagcggtatatcaacagcctgtcgaatttcacggatacgtttaaaatcgagctgcggctttcccgcatagacaccatgtgcagttcctacagaaatcgccaggcaatccacacttgtctgctttacaaattcaacggcctgtattggatctgtatacagacaagcctcacgtccataggaacagccgtctccgacatgccccagttctgcctccacactgacctgtacagcgtgtgcagcttttacgatttcagcagtatcacgtacattcacctcaaaggatgcagtactgcgatctatcataacagatgtaaatccggcacgcaatgcccacatgacctgttcataggttgcaccatgatccagattaacggcaatagggactgatgatcgaacagccatttcttccagcatacgccccagaaaaaccaaatccgggtgaaatacatagcctacatccaagatcagcggtgcatgcagttcctctgccgcctctatacatacgcgggcggtgcattcgttgataacatttggtgccaccacaccatagccctctatcgtcgccttatccagcaaatccctcattggtacaagcattttctattctccttcttattttgtattgaattcaatggtgaaatcatagtcctcctcggtatcctcggcagctgcgctacgattcggctttaacagaagcagtacccctgcagttacagctacaccagcaaggaaagcgaccacaaacaggaatggctctgtgataaacggtatcgcgaaaacaccacctgccggaatcggacacagacatccgaaaattactgccaaaccaccagaaattgcactccccgcagtacatgccgctacaatacgcagcggatcacttgcaaggaatggaaagacaccttctgtaataaagcataagcctagcggaagtgctgtttttgcggcttcatgctctgcctttgtaaaccgttttcttgctaagaatactgcgatggcaacaccaacaggcggtgtcattccactgaccatgcttgctgccttcggtgcatagaccccctgtgtaagcattgcatcacagaaagcgcctgctgcctgcgcaaacggaccacccatatcaaagcgcataccgccaataatagcacccatcaaaaagcctgattccccctgcagggagagaagccagtcagtcataccctgctgtatcattgccaaaggtgtaccaatcagatacataaataccaagccaacagcaagcgttgacaataccgggataacaagcactggcatcaggccttcgatcagcttcggcggcttaatataggttttcgcaagccatgcaaagtaaccggcgataaagccacctgcaagacctccaagaaatcctgcaccaacaacatttgcaagggtacccgccgcaagacccggagcaatacccgggcgatttgctatcgaatacgcgattcccgctgcgataacaggaaccgtgaatccaatcgccgcatttccaatctgctccaacgctgccgcaatcgttccttcctgaatatccacccctccaaaaatcctggaaatccccagacagataccgcctgctacaaccaccggtatcatataggcaatacccgtaagaacatgttttttcagttgcaattttttcactatctccacctcagctttctttcaatttttcttctatctgcatcaataatttttttggtgccttcattaccattttcattggcatatccagaatttttttccctttaaagcgttcccttccggatatttcaatatctgctgaaataatgaccacatctgcttgtgcaatatcctgatcgtccagaatatcctcaacgccaatgctgccctgtgtttcaatctttatttcatgtcccagctcccttgctgcatttacaagcttctctcttaccagatacgtgtgtgcaattcctgctgtacatgctgttatacctacaattttcatacgctcacctttctttcactgtcttgataaaatagcctccatgacatcctgtctgctttccgcctcatacagtcgctgcttcacatcatcataagccagtgatttagcaacagccgccatcatcgataaatgactctgatcagcatcgtgctttcgggcgcagactgcaaagaggataaccacttttaccggaagctcatcaatactctcccagtaaatgggctcctgcaatatgccaaccgcaattctgttttctttcactcccttcgattttccatgcggtattgcaatatagtctccaattcctgtaactccttccgcttcccgtaaaaagacatcactcataaacgcatccatatccattacgacttcatgtgccttcagcatttcagcaagctgccgtattgcttcctcttttgaatctgcctgcatgggaatcagaatatcatcttcatgcaatatctttctcagctccatattccttctcctttatctacttttattatagtgaatttaaaaatatataaatttcgtctttttcctttttacaactggaatttattacattatgcaatacctttttttacctgaatcatattaaaatacttaaaggaaaaactgccggtattttttccgacagttttcattcattgttcagcaattctatttgtgtctatatgctcctgccttctcaggatatatcgatatctgcttactcttttctagtatcaaattcattcataatatcttcacgctgtttttcatcatacaaatcgaacacggttaaacacagactgatgattccctttctcagcttgtcatccgcacaaggcagcttcagatattcgagaaaattaacatcatgcgcataagcgggtgttggtcctttcaatgccagctcactgtacatcatcgggcagacatgcgatacatttcctacatcactggagccgctggcatccgcatcactgtccacaaagtcaccggagccgcaaagctttgcattttccacatacagctgctgaaagctttccaagttgaccagatcataataggtattttcaaaattacgatattccatctgcgttcccgtcatgaaagaagctccctttgcgatattgacgattttcgcactgatttcctccatatatgccttatcggctgcgcggatgtaaaatttgcacgcacacaaatccggaatgatattgcatgcttctccacccttggtgataataccgtgcacccgtgtgtcacagcgcagctgctggcgcagatagctgattcccgtaaacatcagattgaccgcatccaaggcattgactcccagatgcggataggcagctgcatgagctgcttttccatggaaagtgaattctagagagtccatggcaagtgtaacgacatgtgcattattttctgcacccagatgcagctgaaaagcaaaatccacatcatcaaatgcaccttcctcaacaagcacacattttccaccggttgtttcctctgcaggggttcccataataacaatggtaccctccagttcctcctgcatctgtgcaaacatgagccccacacccgcacataccgctccgatccagttgtgtccacaggcatgtgcaagctcatcgtgctgctcaccataccctggcaaggcatcatattctgccaaaaatgcataggttgctcccggcttactgcccttcagctcgcatcgaaatgctgtcttcaaagaaccgtacgggagctgtacagaaaagcctgtctccttcagctgttcacaaatataggcacttgacaaaaattcctgatcaccatcttcgggatgttcgtatatccatttgctgatttcctcagctttggcctgcacctttgccgcatacagctcttccagctgcttttttctttcctctttcatatcgtagcctccactattctcattgatattaccttaaaaatactaacatcagtatttacatatccgtttacagcttgctttttatgcagttgtattaagactttcacatggaataagaaacagagatgggctctctgtttctttcttgtgctattcgattgttacatgttcaaagtagaacattgctgccggtgtacgttccagccccttcacactcggctttttcagcatcacctgtgtatttgttaccagtggaatgaaataagcctgttcaacaatcattcgattctctgcatcatgcagcagctgcatacgcttcgcagcatccgtttccagtgcagccttcgccatcagatcctcgtattctgcatcatcgaaaatcaggaccgcttgagattccttctgccacataccaagatatgctgcggcaggatccagtgtggtggcactcagaccataacggcttgtttcaaactgaccgccgtctacctgctgatagaagacaccctgttccacctgttcaattttcaaatcaatataaattttcttgaactgttcctgcagtatttgagcaatatccatatttacctgctgaccggtcgtcttgtatttgattgtcagctttttgctgtcagagtatccagctttcttcatcagtgcctgtgcacccttcagatcatatttaattaaatcacctgcatcatccgcttctttacggaaatcttccttttctccctgaattccatgtggaaccagaccaaacagtggcgttacataatctcctgtatccagtacctttacgataccgtcacgatcaactgccattgccattgccttacgaacattgacgtcctgcagtgctttattttctgtagataaggagttgatgtcaataaagtaattggatacatatggatctacccgatacagatcatccttacctttataattggtatatccttcatttgcaacataggtagcgaaatcaatctctcctgcatcatagccctggtattgagaaacactgtcttccataatcttgaagtgcagcttttccagcgttgttttgtctgcctcataatattctgtattctttaccagatcaacggcatctgcaggattcacactttccgctttgaacggtccgtttaccggtacatctgcggataaagaccattcagaatccttttcctttgcgatatcggaacgaagcggcgtatagattccctgtgtcatcagcttgtcaaaatattgaacaggctgaatcaattcaatggtaaaggttttgtcatccaccttttttacgccaacatctttcatatccttaattttcatattcttttcataagccttttgcgctccgacaatgtattttcttccatcctgtgcattataagaattctcaggaccgtaagaaagtcctcgcttgataccgtaaacaaaatcatctgcctttactgcttccccatcactccattttgcatccttaatagtaaatgtgtaggtctttccatcctcactgactttatagtcttcacaaagatcctttaccagcttcccttcttcgtccagcttgaacaaggtacgatacatgttctgaattacaatcatggaatatgtgtcatccgcaagcgccggatccagactggtaatctgtccgccaagtgcaaccttgagctcactgctgctttcttccccgcccccgcaggcactcaggctgagaatactgatacccatgaagagtgataacattagtttttttagctttttcatacagtttctctcctttttacatttattatcataccttcttttcgaatatttttcaataaatgtaaatactttcaacataaaacttatataaaagtaaacgtgtttacagaaaattaagcataccggtcgtttgtaaatgttaaattcgcctgattataagacctgcataaaaggagcctgtaacgaactccttttacagactcctctattataattgctcaccgtttgtttcaataactctcttataccacgcaaagctatcttttttaaatcgatttcccgtaccgtttccctgatcatcataatctacgtaaacgtgtccgtagcgcttcgtgatttgtgcacttgttgcggaaaccagatcaatgccactccatgaggtatagcccataacatcaacaccatctatttcaactgcttttttcaattcccgaatatgctgtctgagataatcaatacggtagtcatcatgaatccttttgtcctcacacaatacatctcttgcgccaagaccattttcagttacaaacagcggtacctggtaacggtcataaaatttattcaaggcaagacggaagcctacaggatcgattacccaaccccattgtgttcgttgtaaatatggattttcgagctttccaagcatacgttcattatctgttaaatctggatcgttattcggatttatcggggcaattctagtgaaataatagctgaatgcaaggaaatccacctttccctctgctaagatttcatcgtcaccttcctgtttatgtaaaacaacctgcttttttttcagaaagctgtccgcataattcggatatcttcctcttacaaacacatctgtataatagtaagtttccctgtcacattccagctgttccatagcatcctgtggatttggtgtctgtgcgtaggcaagtgtaccgcaaaccatgcacccaatctttaaatccggatatgatccatgactgtaggctgtcacaagtgcatgtgcaagtagctgatgatgtgctccctgaaacatatcctgttccttattatccttacctctgatcaacagacctcccgcacaaaacggtatcgtactgataaaattcatttcattaaaggtaatccagtatttaactttttcatgaaagcggtcaagtactgttttcgcatattttacataatggtcaataacgcatctatgtttccatccgccatatgcctgtaccagatacaatggcatttcataatgtgatattgttacaagcggttggattccctgctttttcagctcatcaaaaacgcgatcataaaaggccagtccttcctcatttggtttatcttcaattcccttcggataaattcttgtccatgcaattgacatgcggaaacacttaattcccatttccttcattaaagcgatatcttctttataacggtgataaaaatcatttcctgtatgataagtataataacgttccggataaatctttaaattctccgggtattctccggcagttccatcgtatagaatatctgcagtggaaataccttttcctccctcctgccaggcaccctcgcattggttcgctgcagtggcaacaccccataaaaaagttgacttcataacgtttgtttcctcctattcatttccagttcatataatgtttccacaaagaataattcactttgtgttgtcataagcgtatcctgtgcatgagagaacaaaacggttacctcaatatgtttaccttcagcttcttcatgcagtatatccgtctgcgccttgtgtgcaagtagaatgctacccctagcttcctccagctgttgtgcgattgcatccaagtttttcccctctgcgatacattttcctgcatcccgtaaaatatttctggcatttccggcatgcaggataatattcattgcagctgtgatcacgcattcttcttttgtctgtttcatactgtctataccgtttcctttccttcttccgctgcttcttttttcatttcctgattctcatatactttaaaaaacggaagataaatcagataaatcaatataaataacagaatccagaaaatcacccctctgaagtcataatttgtaaggaaggttgctacaggctgtagaaggaagttcatttgaaatgctctagcaggaatatccacaaaacccactgtaagaaccagatagacgagcgaaggtactataaaggagaccagaaggtagggaatcatcataatcggattccatacgacaggcaagccgtacataacaggctcattgatattgaacagggatggaaatatagctgccttcccaatcgcatttattttttttgattttgaacgaagcatttgaatatttaatggcattgtacagcccataccacccatgcagcaccaaccgcagaataccacctcaactgtagtgatgaaaactgcatccttacccgctgcgaccaaatctatattggcagcaatattatttaacgccaatgcaaggaaaatcggatacacagcccatgcgctcagtccgagactgtagcataatgccataataaaatacaataatacaaagcctaagtatgtatttccaatagctgctattggagacactacttcttccatcagatcgaacaggttaacaccattgccagcaatcaggatagcgatgccgataacaagaaacacaggcacgatagattcaaaccagttcacaacaatagaaggcagactcgtatcctttgaaaaaagaccatgcttgaaataaacagcgaagattgcaccaatcaataagccgaccagcagtcctaccgtcatccctccagttccgatataacctgcatttaatgaaatattaccttccttgaataccggattacacaacgccagtaatacagaaacaccggtaaatccggatatgagtttcgcacgattctgtttcttattttccatgatattatacggaagtataaaggccagaaaaatgccaatcaatccaaaggaatactgatttactaaagacaaatccggtacccattcccaaaaattacgcagagtattgatcagactagcaatggatcctaccaggatcattggcaatactgtctgaaagccgttttgtattgccattacataggcattttgtgtaaactttgatatctttgaactaaatggacctgccagccaggcagttatcctcacataaatgtttttcatattttctccttttccctcactcatttaacaatgacagcacagtgtcaaatcctttttctccgtccaatgttgaataaacgaaattatccagtactgcatatggtttatgatgcacagcacaaatatcccgtatcatgtcctcattgaatttcatttgcggtgcaacgagtaccacatcaaattcatcgacaacctctgacagctgagaataactgtatgcatcagaaacagcatcatagcccctcgctattcctgcctttctaatcttctgtgcaatcattccacttgatacaccatttccgcaaatcagtaaaatcttcatgtaattcatctcctttcactctttgcattttcattatcacataagctcgaacatctgtctttccataaatttcctaggtataggaaaaaaattatttggtaccttttggtaaatatatttataatatatacatagagggtatattgggagaataaggagatcgttatggataagaaaaagaaactgcttgctttattatcaagtgcaaatcatcctgttacaggaaaagagctttcttcacgcctcaacgtttcagatcgtacgattcgaaattatatccgtgaaataaatgaggaaaaacttatcattcaatcttctagcaatggctactggataacagtattagatagtccatgtaataaaaggaagattgaaagttccctcgtttatgatttctcgtcacaaaatgaacgtcttttatatatagcagaaaggatcatcacttcatcagaggaagcagatctttatgatatagcagatgacatttatatcagctattccaccattgagaaagacctgatacaaattcgcggtattataaaagatttccatctcactcttctgcgtggtaacgggaaagccaccatccaaggtagtgaagagagcaagcgttcttttatacgctatctgctttctcaacaagattctgcaactgtgcaaaatacgctccatgccatatgtgaagatatacatattcccttcgatacgcttaaggatctgattatttatcaaacccgtcagcaaaagctttatgccagtgattatgcgataaaaaatattttaacgcatgtcattataactttatcaagattacaaaataagtattctttgcaattacaaagttctccttcggcaaaggaaaaggaaccggaaagcatttgtgcagcaaatatcattcaggaaatagaaacaaactataatattatgtttaatacagaggagaaaaatcagctgatatttttacttatgagtaaaactactagattggatcacaataatcaaactagaaagtatacacaggatttcataagtctggaatacatagagtttacaaaacagttggtagagaatatcaattatatttattatattgatctaaacgattctgattttattaactttttctccctccatttgaaaaacgtattgtttcgatggaacaacaatacctttaataccaatcctttcagtgatcagatttttattcagaatccgctcatctatgatattgccgtttatatagcgaatgaaattcgaaatagatatcactgtaagctgaataaagatgaaatcaccttcatatctttacatattggagcagttatcgaaaaaaaagcggaagaaagccatacgtataaagccctgcttataatgaatgaatactattatccggtttcaaattacctttatcaattccaaaaagaatttcagaataaaattgacatagtttccattatgcaaagtattcattcgatagatacagaaggtatagattttatcatagatgcgtccggagaacaaaacagatcatatgctgttccaatggtatatatcagccctcttttcgatagaaaagatttgaataaagtatatgatttccttaataaacttattgaccagcaacatacaaatacgatgaagcatcaattccattcctttttctctaaggatatgtttgaactggagcattacgagcttgatgcaaatgccatgataagatatatctcacaaaaacttattgatgcaggaattgcacctgcatccttcacacagtctgtcttggagcgtgaagaaataacctcaacaagctttgacaacaaagttgcaataccacattctatactttgttcgacaagcagaaactgctcttatgtaatcgtcaataaaacgccaatgaaatggggctattttgaggtcaatattataattatgattggtataaatcacaatcagagaagattttttaaagagctttatagtaatttattggaaaagctccaagatatgaccatcatacaggaattgatcaaagtaaagtcctacgatgcgttcattaaacttcttaccggtgaatgctgatatattttttactctgaaacaaactgcgtggaaaagcagaggacttaaaatcctctgctttttctagtggtattaagcgttttataatattcctgaacctgcctcatgattgtcaattttccagatcttcgcaatcctgtaatcactttaattacatccatatctttaaagcaagcaattttagaatgtaattctcacgatatagcataaacttcaccccttcatttcgattatactcgaaataaattatgtttttaatcactttatcgactataatcgaaatttttcgttaataggttgtgacaaataagatggtatcctaaagctaacgcttctccagtaatatcaatttttgaatgctatacgaaaaacacgctttctctgtttgatcaaataggattttgcgtgtttttcgatttcacgactgtttgttgtcccaaatgattccagtatcacaaacagcatcaattcttttcttttatctgtttttattaagctttgttatataacaggatttcttataaaatgcaattccatatccaataaaatcagtatatccatctgcaagatatccctcgatatattgtttttctctgatttgttctgcggctgcttcactctccgcttttaaacttctcagggatgcagcatgtttgcactcgatgatcagtcctcttttcgaaaaatcatccggtatcacagccaaatcaaaccttcccattccagattcacgatttgaaatgacatgaaattcctgaagcatacctgtcagaaatccatgatagaaatcttccttcgcatcaaaataactgatggattgaaataaaattgcattcaatacttttcttgcttcttcttcatctcctttgtataatgctgtataaaaggaagtactgtttttctttatgactgcatcaaaccactgtgagaatatctgaacataaatcatttcgatttctttatttggaatctttaagtaatatcggtataagtctgatgatttttcaatttttaaatatccagtaaataacagaaaactgtaaatattatcaatatcatccatttctcgatacgttaattctgatttaatattcttttcaattgcatttcctttcatcaattcatcaaactcgactttcatctgtgcagttccctgttgaatgtagcgataaatgatctcattaccactggtgtttgcccagaatgattcaggtactggcgattcctccatacctttttttacatacttcaaaacgctccagggattatatacctccgtttgattgaacaaataaccatcacgccttgggcgggcagcgcctaccactctttcacagttgcttcgcaagaaatcatatcataggattctaatagttcttttgtttcttctgatgtaaagccaaaacaactgcttgattttctttgaagtatagaatatacattaaaattattcaagcctgtaaatacgctctctttggcgattcttaaacagcctgtcaatacgcctttccctaacgcgtcattcgttttcaaagctgtactgaatacatttctaagaaactctatcatttcatcatagtagccattaagataggcgctttgcagtggaacatcgcgccttgggcgggcagtgcctattcatcaattaaaatgatcgtcttttgttcataatgtttttccagaaaaacacttaaattgaataaggcatccataagtttatttactggggcagcttcattcaaatactgtgacaatagttttctttctgactctcgtaatttagggctatccaacagctcagcgtattgatcaaccagcatagagatgatagatttaaatttatctatttgcgcttcaaaatgattccttttcatatccttcaatgtcaaaaacaaaacaggatactgattctgatgtttacatgcttctttatcctttgagatttttaatccattaaacaaatagctgttttctttttccttgttggaaaagaaatagtataacacgccatgggcgggcagcgcctgctcatatttagcgttttcccaaatcttcttggtctggtgtacaaagcaaccttttcgctagaaacatctttaatcagcgccgttttatctacataataatacttattatcaatcaattctttgaagttttctattccaatcggcagcattttcataggatcatcagctcctttttatagtatcgtcattatatcacatttttatctttccaagttctctttttgaggtaaacggagagaaacatgcatatggaactatgctttatttattatcatatcctattttcagtagagtgtttttatttccttgaatacctcccatgtctttggcgtatttccccctaatcatttctagtataaaacgtagatctaccaccgccatgacgggtgatttcaccctcatccaccaatatcttcagggccttttcaactgcagcacgccgaagtgcaggtaagtactcaacgatctgagcttttgtaaatttgcctatttgttcctttacggcatttcgcaccatttccagagccggtttcttttcttcgaccaattctaaacgattttcgaaatctctatagcaagctaaaatgacgcctagaagatatttgataaagggtgtgacatcattgtctccttcatgccatccctcatcgatatcctgcaatgcttcataataatttaattttgttttagcgattttagtttctatactgatatattttcccacctcaaatccgctcttataaagaagcaatgcggtcataagtcttgacatgcgaccattaccatcattaaaaggatgaatacacagaaaatctgtgataaaggatggaattaacagcaagggttcaatatcagcagcgattgcctgattgtagctttcacaaattacatggattgcctgtgatgtttcatagggagctaacggctgaaatcgaacagctctggttccatccgctcgtacttctgtaatgtaattttgcgtattcttgaattttccaccaaaggattctcctgaataactatatagaaccttatgaagctgcaggatataattgctttggattggtatatattcatgactttcatgaatcatgttcagaacatctcgatagccggcaatctcttcttcatccctgtttcgcggtgatgtcttctcgttgaccagctgtttaattcttgtatccgtcgtaacaataccttcaatttgattggatgcttccgtactttgtactttcgcaatttccactagcttttccaaactcatcggtttctgtttgatatagagttcctgttttcccttgtattcatggattttagcaatcaatgttaagacttccaaatcccattttttatctctaatcttcagatagtcaaaagatctcattctgtaccacctcattattctcctattatagcaaaaattcaggagaaaagctaaggctcataggagaataataaagataatctcctatcaattcccatattctcctataatattgtataaaataggggaataaagaatattgtaggagaatacgatatcatttcaaattcattacgatgatggaacaggcatatcctaaggatctcatcaacattcgtatatttcaagtttgttctataaacatttcccgcagtcatgagtttaaattgtgaaaatgaaaaaagcgattctattgctgaaccgccttttgctatgctacttcaaatgtgcgtcgaaccagtctgccatttcctgcagtcggcgtaatctatgctttggttttccactcctgctcagctcatgattctcctgtggaaacagacacatgcggctttccacatcatgatactgtaaagccgtaaacatctgcagtccttcactcagcggacaattataatcctccagagaatggataaacagggttggcgtctttaccctgtttgcatatgccagcggagaagccttccacatcgtcatgacatccttccacggtgttgtctgcatctcattgggatcaaaggtatagccgatacagctggtaccgaaatccgatgtccagtttgcgacactgcgctgggaagcggctgcctgaaaccggtctgtctgtgtgatgatccagtttgtcataaaacctccatagcttccgccaagcacacccaagcgcccgctgtccagttgtggggtttcctgcagcaccacatccgtaaacgccatcaaatcctcataatctatcgtaccgtatttcccccgcaggtccgcatactcctcaccgaaggaatcactgccccttgggtttgtgtaaaataccatataccccatggatgcaaacatctgcatttcatggttgaaaacatttccatatgcgcagcgcggtcctccatgaatactcaacagacccggataccggtttccttccacatagtcagccggatataaaatccagcccttctgtatacctccctcacgattggtatacagaatttcttttggctgcacatgccgatgcgtctgtaaatactccgcattccatgctgtgagcttctgacaatcatcctgcttgcggtaataaatttcctccagcgcattttcttccatttccagtgtataccagccctgtgcgctcacggcaatatcccgtatcacattggcttttggtgtcagacagatatccctgccatccatggacaatgcgtacagcaggcagcgaccttcctcatttttcagatggtaaacaatctggttcttcatcatgatggatgtggaggctccgacatggcagtcactcactatattgcaatatgcgtaatgctcgcagtccagcagctttttcacaccctgttctttcgtccagacataaatatccgccgcctcttcattgccatactgctgcatatccgttcctgtgaaaacaacggtatccttctcacaggtaactgcttcaatgcgtaaggtgtcacagttgagaagctctgtttgacgcagggtatctgtggtaaaggtaaaaatcccctgtgtcagcggcttctttgtggaatactcctgcgcgctacatacaatttgcgtatttgaaaccgacaggttttccacatgccagtttcctgcaaacaacgctttggatgtctgactttcctcataatagacatacaggtggtttcgtttcccgctgatatagccgacaccgttatcccagaagggaatctgtgtcagcacgatggtgtcatcatcattctgtttctgtacggattcctctgccagataggcatagtgctgcacacttatcctctccagctggacaacattcgcaggtattgtaaaagccggtgtggtgcataaggtatccagatgcagacgaacaaattccgttttctgttcctttgcaggcttttgaatcagcagcgtatgttcattttcccacagaaaggcggaaaacttctgcttctgatagatacagaaattcctctttccctccaacagccacagatttttttcgtacgtatcacttgcttccgccatctgcgtatgcacataaaccagacggtttccggaaggtgatgctttcaagccgctcaacagatgcagctgatagagatcggttttctctacaccctttttcatcccttatttcctctttcctgcatatgctctttcaatagttcacagatttcctcatatgccgcattgacatccgtattcttcacagtatggcgaaagagtgtggacagctccagttcaacaagcgccttgttaattctgcgctgtgcgcttgccgcatcatcccgataccgcagcatgatctgtttctccagttcctccatgctttccggttccacgaatacgcacagagcgtccggatattgcagcttgatctgcccaacaccctgtgcttccacctcaaccatgacatttttcccactatttagcagaaaatccacctgatgctttggtgttccatagtaatagccgtcaaactctgtatactccagcagctcacgatttcgcaaagcctgcgcaaaggcttcatgattgacaaaataataatccctgccatccacttcctccccgcgttttggacgggttgtcatggaaatggaataattcagatgtagttgttcatcaccaagcagccggtcacggatatccttttttcccacactgctggcgccggttaatacaaacagcaaacccttgttcatgatgtttcctcccggtatcttatgcagcaggaatgagtgccgcataccataccttttcctttctttcaaaaaaacgaaaacacagccggatggacagtgcttcgttttccttttatatgatcacattatttttcatacaggaagcaggcaaccgttcgtttccctacgtttaccattcccggcttttccctggcacagcgctctgtggcattgggacagcgggtacggaatacgcagccgctcggggtatccagcggactcggcagctcgccctccagtacaatgcgctttttttctctggcaacacggggatcgggaatcggtaccgctgataataaagcctgtgtatacgggtgaagcgggcggtgatacacatcatcactgtctccgatttccaccagatttcccagatacatgacaccgattcggtcggatatatgctttaccatgcttaaatcatgcgcaataaacagataggaaatgcccatttccttctggatatgctccagcagattgataacctgtgcctgtatggaaacatccagtgcactgatgggctcatcacagacgatgaactgcggattcagggcaagtgttctggcaattccaatacgctgacgctgtccgccggaaaattcatgcgggtaacggcggatgtgatccggcttcagcccgacgatatccagcagctcgcgaacccgctgctcccgttcttccttcgtgttgaaaatatgatgaatatccattggctcacggataatttctcctaccgtcatacggggattcagacttgcatagggatcctgaaaaatcatctgtacattcctgcggaattccgcaagatggctgcctttgattttcgtaacatcctctccatggtaatacaccgttccgcttgtgggctcataaagcttgacgattgcacgaccggtggtactttttccacagccgctttctccaacaagtccaaaggtttctctcggatagatttcaaagctgacaccgtccacggcctttaccacctgcttttttgtgaacagaccgcccttgaccgggaaatgcaccttcaggttttccaccttcaatactgcatcactcattggacttcaccacctttgcatgccttgggatgctgcagccagcaggaacagcgatgcgtagcagatatctgtgtttcctgaggcatatgcagcttacatatcttcattgcagatgcacagcgatccgcaaacggacaattctcctgaatattcaataaatcgggaggacttccgggaatcggatgcagctcctttttttccaactcattcggattggaaatacaggacagcagaccgatcgtatacggatgctgcggatgttcaaagatttcaaataccgtcccggtttcaacgatttttccaccgtacataatcgcgatacgatcacagatacttgccacaacaccaagatcatgcgtaatcatgataataccggaatcaatttcctccttcaaatgggaaatcaattccagaacctgtgcctgtatggtcacatccagcgccgttgtcggctcatccgcgataatgattttcggatcacaggcgagtgcgattgcaatgatgatacgctgccgcatgccaccggaaaactgatgcggatactgtcgtattctggcttccggagaaggaatgccaacctttcgcatcaattcgattgcgcgctttttcgcttcttcctttgatatatccatgtgattcagaatcggctccattaactgcgtttcaatacgcagaaccggattcagaaaggtcatcgggtcctgaaagatcattgccagatcatttccacggatgtgatccattacctgttcatattccttacggtcggaaaaagcctttggcgatatttccttgccgtcaatggtgatactgccatccttcacgatcccgttgcctgacagcagccccataacggaaaacatcgtctgactctttccggaaccggattcccctacgattcccaaaacctctcccttatccacagacaaagacacatcacgcacggcgtgtaccataccgttttctgtttcaaaatcggtagagaggtgttgtatttccagcatactcatatgattccctccctacttcttctttttcttcggatccagggcatcccccagaccgtcaccgataaagtttaatgcaagcatcgtcagacagattgccagaatcggccacagtgtctgcagcggatacgaggtcagggtacttcttgcctcatttgccagcgttccccagcttgcctgcggtgcgctcagaccgatgcccagaaagcccagaaaggcttcatagaatatcgcacttggaaccagcattgtgacagatacgatgatcggccccatactgttgataatcagatgcttgaaaataatacgtccggttcccgctcccagcaccttggctgcaagggaaaactcctgttccttcagcgtcatgacctgtgctcgtacctgccgggccatccccatccaggaggagatacagataccgatcagaatggagctcatcgacggtcccatgaccacaacgatcataatgacatacagcatatccgggatggaatacatcatatccacaaaccgcatcattgccatatcaattttaccgccgaagtagccggctattcctccgtagagaacaccgacaccaagagaaatcagcgctgccgcaaagccgacgcttaaggaaacacgtccgccccacatgatacgaaccagaatgtcacgaccgaatttatcggtacccatcaaatgctgaagggacggacctatattgcgcagctccagattctgtccgtcataggtatagggggatatcattggtatgataatcgcacacagcagcatgaacatcagaaagcagaagcctacaaatgccagcttgttctgtcggaaccgatgccatgcatccgccagataggtccggctttcatatgctattttttccgcatttttttcagaatcatccagacgttcaaacagatcgtcgctcaattcttcctgcaataatttatcactcatagccttcacctcctaatccagcttgatccgcggatcaataatggcggacaggatatctgtaatcagattaaaggtgatgacaagaaaaccaaggaatatcgtcagccccatgataatcggataatctcgtgttgtaatacaggatacaaatgcactgccgatacccggtatcgagaaaacactctcgatgacgaagcttcccgtcagcatgaaggcgaacatcggacctgcataggtcaccaccggcagcatggcattcttcaaagcatgcttgatgacaaccttcttatacggcgtacctttggagcgagccagaatgatatagtcctgattcataacctccagcatactggaacgggtcagtctggctatcatagcgattggataaaacgcaagtgaaagcgccggcatgatgtaattcagcgggctgttcaagccgataaacggcaaaatatgcagctgtaccccaaatacgatcagcatgatcatcgcaatcagaaacgacggtacgctgacaccgatcgttgccacaaacatacacaggttgttcacccacttatgccgtgataacgctgccccggttcccagtgcgattcctcccaccagtgccaggacaaaggcaatcagccccagacgtgcggttaccggaaagccggttttaatataataggaaacgctgcgtccggtattgatcatactttctccgagattcccctgtgcgacccccttcaggtagatcacatactgctccaccagcggcttatccagattatactttgcctctgcggcagccagtgcctccggtgtcttatacttcgccagggaaaatggtgatcccggcgttgccttcatcagaaaaaatgtaacgctggctaatacaaacagtgtcacaaatccgatcagcacacgtttgatgatatactttggcattcaaacaaccccttttctcattctataatagaaggatactcccgatgactatatcccgctgtgttaattcggatttttggtaatacttaacaccttgtatccatttgcttccagatcacttgccaacgcgtctgtctggaaggtatcaatacggatgatcatatccgcaaagccgttgtgctgagagtatacccccagatgggtgatattacagttattgcggacaaagatttccgagattttaccgatcgttcccagctcgtccttgacttcaatgcagacacggcttccgcttgtacgatagcccagaatatccaggaatgcagaaagaacatcgttgctggtcagaatgccgacaacctcattggcatcattgacaaccggcagacagccgatatcatgcttatacatcagcagtgccgcatcctccagaaaacggtcctcgtgaatcgtgataacatcgcgaatcataatcgcgtccacgcttgtctttgaaagcaggtaattcagctcataaatactcagactggttgccttgctggcaccctttttggagatcatgccctccgtaaccagtccgaccagctttttaccgctgatgaccggaatacggtgcagctccttttcactcatgatatcgacaacatcgctgattttactgttcacatcgatacagatcggatgctttgtcattctgttttttacgtacatagtattatcctcccaggtatgctttctgaatttccggactgttgaccagttctgcaccggttcccgtcatgacgatattgccggtttccataacataggcacgatccgcaatggacaatgccatctttgcattctgttcaacaagcagaacggttgtccctttttcattgatatccttgatgatattgaagatttcctttaccagaatcggcgcaagccccatgctcggctcatccagcagcagaatcttcggccgggccatcagtgcccttcccatcgccagcatctgctgttctcctccggataaggtggaagcatcctgtgagcttcgcttctccagaatcggaaaccgctggtagatatcctgcagatccgctttgatgccgtccttgtccttacgcagataggcacccatcagaagattttcatatacactcataccggagaagatatgccgtccctccggtacctgtgtgataccttcctttacgatattcttggcactgaccttgttcatggattttccaaggaacacaacctctccgctcgtcttcttcagcaggccgctgatggtttgaagcagcgttgtcttaccggcgccgttggcaccgatcagcgaaacgatttcgccttccttaacctccatggatacatccttcaatgcatgaattacgccatagtggacatttaatttttctaccttcagcatcttaaatatcctcccccaagtacgccttgatgacgcgcttgtcattcttaatcacttccggaacgccgttggcaatgcattttccataatccagcacataaattcgctcacaaatcgtcatgaccagcgacatatcatgctcaatcaggatcacggtcagatggaagtcatccttgatctggtgaatcagtctggtcagatctgctgtttcctgtggattcataccggctgccggttcatccagaaacaataccttcggctttgtggcaagcgctctggcgatttccagacggcgctgttccccatagggaaggttgctggcaagctcatttcgcttgtcgtacagatgaaccacctttaacagctcctctgcctgctgctccacacgttcctcctcacgataatagtttggtgtacgcaggattgcctgcagggttccgtatttaatattcttatgcattgcgattttcacattatccagcgctgtcagatttttaaacagacggatattctggaaggttctcgccagccccatacgcgttaccgcatacggcttcataccgccgatttccttcatcgcgccatcgacattcagctcgattttcccctcactcggttcataaacaccggtaagcaggttgaacagcgtcgtctttccggcaccgtttggaccaatcagtccaatcagctcctgttcattgatttccatatttacattggacaccgcacaaagaccaccaaagttctttgtcagtccgctgaccttcaacaatgccatattaacgcacctccttctttttcgagaaccgcctcagcagacccgagaaggtgaattccttggttccaaacaggccctccggacgaaagaccatgatcagtaccagtgctgccccgtaaataatcatacggacatctgcgaaattctgaagatacatattgataaagccgataacaaccgccgcaacaatggatccggtaaagcttcccataccgccgaacaccaccagaatcaggatgtccacggatttattgaaggtgaacaggtccggctttacaacatagaagttgcaggcatacaaggcacctgccagagatgccagaacagcaccgatcacaaaggcgattgtcttatattttgtcgtattgattcccattgcctcggatgctatttcatcctcacggatggaaatacaggcacgcccgggtgcactgcgtgaaaagttcagtacaattaacagggatacgatcaggcagaacagcagcagcggccaggtcgtcagcttcggaataccgaacagtccggcagccccgttggtaatcgtcatattcaatacgatgatacgaacgatttcagaaaaaccaagcgtcgctatcgccagatagtcccccttcaagcgcagggttggtatcgcaacaaccagagcgacaagcgcggagatcacaccgccgatcacaacggcaagcgcaaagccgcccagattcggtgttgccttggtaatgatggcagccgcataggcaccaatacacataaagccggcatgtcccagagagaactgaccggtcactccgatgatcaggttcagggagattgccagaatcatgttgattccgatggtatataaggtactctgataatagaagttgattacaccgccctgcatgagcagcgtgatgatcgttaacaatgccgttgtgaataaaatccagcaaaggttcagcttactaaagatatgtttcatacgcctacaccttctctttcacatttttgcccagcagtcctgccggcttgatgatgaggatcagaatcaaaatggcatatacaacggcatccttatataaggagcttccgtatgctgtgacaagcgcctctacaatgccgatgaagaagccgccgaacatcgcacccggaatgataccgattccgccgaataccgcagcgacaaacgccttgataccgggaaccattcccatcagcgggttgatcgtattgtaatacataccaaccagaacaccgccggctccggccagtgcggaaccgatggcaaaggtataggaaatcgttgcgtccacattgatccccatcagctttgccgcatccgcatccacggaaacagcacgcatggagcgtccgattttcgtcttgcgtacgataaactgcagtgcaagcatcagaatgatggtgatcgccagaatgtaaatctgctgcatctgaatctggatgccgaacacatggaaggtttgattgctcaatacagacggataggttttaacccccggccccatgatcttctgtgtggaatattccagaaaatagctgacaccgattgccgtaatcaatgccgcaattcgtgtagcattacgcagtggtttatacgcaatgcgttcgataataacacccagcacaccgcaaaccaccatggccagcagcagtgccggaaaaaagcccaaatgtaactgtgctatggagatgaatcccacataggcaccaagcatgtaaatatcaccatgcgcaaagttgatcagcttgataataccatacaccatcgtatatcccaatgcaatcagagcatagatactgccaatggaaagaccgtttaccagctgttgaaaaaattctgtcataacttcacccctctatactggaaaataggagaaagaatatctttcccctattctatacttcatcgtattctactatttgtttggatcaacttcaactgcatttttctgttcgccgtctaccagctcaacaacaagtgcagccttcttcggtgtatgtgtttcatcaaatgtgaaatctccggttactcccttgaaatcaagctcagtcatagccttctgtgctgcttccgtatctgcacttcctgctttttcaaaggattgaatcaagacgttcgtcgcatcatatgccagagcggagaacatgcttggatcttcattatattctttcttgtagtccgcaataaactgtgtcagtgcatcacttgcatccacggttgtataggctgttgtaaagaatacatcgttcaggttcttgtttcctgccagcttcacaaggtcggtagaatcgaatccgtcaccgccgacgattggtacatcaattcccatttcacgagcctgcttgataatcagacctacctcattataatagcctgggatatagatcacatcaaagtccattcccttgatttttgtcagctgtacgttgaaatcggtatcctttgcctgatagttcagctcggttacgatgtttccgcctttttccttgaatttatcttggaatgcttttgataaaccttttgcataatcagagctggagtcggaaatgacagcagccttggttttctttaaggtatccttagcataaactgccatggcagctccctgataagggtcttcgaagcagacacggaatacatacggatacacgctttccttcgtcttaccgtcctgcagcgtcacattggttgcagttgcggatggtgaaacaaccagcaccttattatcggtagcaatctggtaggttgccgcagaagcgccggaggttgccggtcctacaatcccctttacaccatcggatgtaatcagcttggtagctacgtttgtggattcatccgcctgtgatttattatccccttttattgccttatagctgaacttgttgtccttgtttgcatttgcctgtttgatggccagcatggagccgttgtattccggcgtaccatagtttgctgtctccccggacagctcatagtttaaaccgattttgatttcgtttgtatctccatcaccggagcctgcatcaccgctgtttccacaggctgtcatcgttgtcaaagccatacagctgactgctgccatggccataaatttcttaaaatttcccatgttcctctctcctcttttcattttccttatatcaattaccgttaaaattgatagttctattatattcgctcacggattctttttcaagtgttttctgcaaatttttcacacattttcatgacattatgtaatttattacagtactccatctgtttttcttgcaatgcagtttgtaatagtcaggttttttcttattcaatgggtaaaagccataccggcagcattccgatatggcttttgattaaaaaaaaagccctgctttaataaacagagcttcgttctccatcccaaggttcgattttcagctttgtaaaggtgacctgcttaccagcgccataggaggatacacctgtgatgatctgattagcgcccacctgatccgcaaactgggtattcattgctctgcctgccggaatcaaagcatccttatttagcagagtatcgttgatcacaatgtaaatggagcagttttcattatctctgttatatttcacaaacacccgaagcgtaaccggacggccattcaaagcaggcagttcggcttttggaatccgataatatacctgatgattggaatactccacatactgatcatgctgattgagattcttctgaaatccctgattgataatcacaagatccccattgtcctcaaacttcaaaatattccccattgcagtatagttcgttctgccttcctctccttcactggtcacattcgcagagccgccaaattgaaaggcgatggattgcagggtatccggcataattgatgtcagctccactgaggccatgtaatccccctttgcgggtagcttggtatgctgtataaaagctcccgattcattttgcaggataatgcttttctgttccttatcataaacggcggtgctgcctgccacggtatccaccatctcatagtgaaagaaatcatcgatcgtaatttctcggtgaaaggtaagctcaccgctgtaggattgagaatgcgtatagactgcggcgctatccgaaacggaagatagcacaatcgcgcacagcagaacaacagcaagcattgcataatttctcattcctgcattcctccttactctgtaataaaccctttctttttcagataggcgagaatcggtttgtagtaatacagcataaacgccggaatcaacaatagaatcagtcttcctaaaacagtattggcaaacaggatgatcgcccccagccatcggcttcttccgctgtagcgtccatagaccgcatcgcgtgctatgactttttcataggctccttttttcacatcgtccgtatacttcaaaatatcaacggaaagcttttctccctttaccgccttgatgcttgcgacctgcggaccgtcatcctcatggtacagaacactctgcccggcatgcagtggctcctgtttgtcgattgcatcaaagaacgccagatcattatacataatctgcggctccatagattccgtatggaagacaaacggtatcacaccgaagaagttggtttcccgctccggtgaggataaggatacaaacagcacgaacacattgatcagaacaccggccgtgattagtaaaaccatggccagattcaccagtgtatccattccctttctgcgctgtctgcgtacatactgctcctcgacctcacgatatccgtcctcctgaagaacaacgatattcacatcctcacccatatccatatcccgttcataaaacggaaaattagtatactgagcaattcgcttcgcccgaaagacaaccactagaacacagaggataatcataatgataaagtacaacaggtaggagcattgcgacagatcaaataaattcccgggtgtactcatccatatacgatcactgatcagatgataataaccgcattgcagccgcagcatccagatgcataccgcaccgatgataatcacgtaccgtgcattcctctgacggctgatgaacaaagaggcgctcatggtgatcagggacaaaaagatcagatcaatcagtccgcatatatataagggaagcatatatgatacgacaaacggatatttcagaaacatggtcagaaacagcgttgccaaaaaaccgatggtatagtaggcaatcacctcggacaaccgcatcagcagcttgacgagaatcatgcgatgaggcgcataaccgttttttgccagagtataccatttattttgtgagatttccgcataggtcagaaaatcataatagcgaatcatgtaggccgtgtataagataaaggccatgacaatatacagggagagtgtggaaaagtagcttggcatcatcagctgcggcagagcggtggataatacgctgcgcgtcagggtctgcagcatgaaatgcagggaaaaggttaaaagagctacgatgattccgtaaaagaaaatcttgttgcggctctcttttctttcaacaaacgcctgcttctgttcctttgtaattatattatggttgtaaatcatgatggtttcttatttccttccaggcattttccacacacagtggatggcggcggatactatccggatgcagctgatgctcggtaagcagtttccagatgctgtgataggtatccgttttctgttcctgatcccaaacatataacgtttgctcccgttccagaaccgtatagtcgctgtgcgccgtttctatcgcatgtcgtatagctgtaatatgtgcatcctgtataatcgtactcaggtgatcccaggtttgcacaaaggcttctaccgttcccgtatagagcagcctgccatcatataaaggagcgatatgcgttgcacagcgttcgatcagctgatagtcaaatgtggaaaacagcagtgttcgcttctgtttttggatttcttcacagattgcggcaattgcctgaagactgcgttcatcgtattccaaccgtgccagattccagataatcagtttactttccgtgaacagtgatacaagaagtgtgaccacagatcgctcagacggtgtgagatttcctattacggataacgcgacatagcccatgttcagttccatgattttctccagtatacgtttctgcctgactgccgcatccccctgctcacgcgctgtgatatacatcagatactccagtacattcatattggtaaacagcatatttgtacttcctatataatatacatgtggaaggatggttctttttttgcgcatcatgcccttttgcgcaagtacacagcgtccgtccttgtagggtcttgcatttgctataatttccagcagcagtcgcacttcgaacgcactggtgccaaggatggcccacacctcgccctccagcgcctcaaagttaatatccgaaaacacctgttttggatcctgctgcggactctgataatattccatggagccgacatgctccatcagtacgcactgagcgcgtttcttcgcttgttccatagcgatcacctaatcactttccgatgtgaaccggaagggtagcttcatcacataaacggcctgtatgcgatccggtgtgaggatattggggtctacagaattagcgggattatcgcccttggtacgatatccaatcgctcccttttcctgtatcacctcaacaatacggtgtgttatagttactccgttatcctgaaaggtgacaatatctccgaccgcaagctttgccgcgtcctttggaatgcgggagaggatgagtgattttacagggatagtcggtaccatactgccggttttcacttcatatatctgataaccgcatacagtcggtacctctcccctgcttcttgcatcctccacctgcagccatgtgataaacagaaaggcaatgataagcacgcctgccagattaccaatcagcttgaacagctttcttctggcaatgcgcgtatgtgccttgctgtcgagatcatgtgcatgctccagttcgtccagcattgcctgcagctgtgcttcgctggtatacacatcctgcttcatttcctgtatgttccttacttatttattggcgggcttatattccggctggttcatactctgcaagattgctgcatccgtggtctgcgtaccggtcactgttacagaaataccggatagcgtgtctcccggattcgcctgtccgtcatctttaatagcgccatcactaccgattgccgtatccagcgcatcattgcttccagccgtatccttccaatagaagccaagcttataggtgctgtctttttcaacattcggagcaaattcaccgagcttctctaattcaatcgttgtgctgccatctgctcttgttccacttgccagtgcgacatccttatcaccatccacgcgatataacgtgcatacaagatccggcagtgccgctgcatttttcaaatccaccttcagcttcaaatccatcggaacctcggtaacgatatgctccttatgattcgtcacctggaaatcccagaattcttcgtttcccggagccagctttatgttaattttatccgttgctgtagagtttatataaaactttttcgcgcttaccgtatcattcgttgctccggcaagtgtatctgcatgtgtgtaaacggccatggttcccgcaaccatggatgtagcgattgtaagtgctaaagcacccataaataacgtttttttcatttgtctctttcctctctcttcctaatctgcagcagtgctgtgatggtcattgccacattcatcgcaaatggtatataccacttggtctataccatataatactaggacacaaaaataaatgcaagcgttttcttaacattttatggaaattttctgaaataaaatgaatgttttattttaatgcagaaattgtaaacaaggatattgtatttaatttatacatcttgaacaaatgataggcgatgtattctgcagaagctgtactgtcattaaataacaaggagcatgaaagcttgttgaatgcgtacatggaaccggaaaagttacacccgtttctgataataagccgtgaaatctgtgctaaggtttttacttggaaaggagaattgataaaacagtttaaaagaaagaaaacatgaagtttctaaattcacaggataattacttcctcatttttccttatttatacttgcacccaaagtgagtaagaatccctgttatattcgacaccttcttttttaaaatccttccttgagaagctaaatttataaaaaatttaagttgcattctcataaaagtatagtatactagtaacagttattatgtttcagggagggacacgaggaatatagtaatgagcgccaggacctacgtggttgacgaggataacagttatcgaaagattcggcgggtactgttacggttatgtgtggatcgaaagatttcagacaaaagcaagatcatactgctacaaaactgatttcatcacacatttatatatcatacaacagaattttcatttttttatcatgctcttcacgaatttgcgtatacgcattgcagtacatgcgtatacaaacacatttttttagtatgcagtttcatcataaaattgacaataacgaaaatggaggacaatttatgtgtggaatcataggctatgcgggattatgcaatatctcaaatagtgttttaattgagggtctggaggctctggagtatcgaggctatgactctgccggagtcgccgttgtacatgacggcgaggttcaggtcgttaaggcaaagggcaaggtcagctttctaaaggaaaaaatggaggctgtaggcttagccggcggtcaggtgggaatcgcacacacgcgctgggcaacacatggtgaaccgagcgaaatcaattcccatccgcatcaaagcggcaataccacgctggttcacaacggtattatcgaaaactataatgagctgaaaaaagaactagaaaatgcaggctatacattcaagagtgacactgacagtgaaatcgcctgcgcgtatatcgactactgttattttttgaaaaaggacaagcagcaggctcttgcatgtgcttatcatcatttccgcggctcctttgcatttgccattatatttgcggatgaggcggatgtcatctatgccatgcgaaagaattctccgcttgtacttggtgttgcaagtgacaaggcattccttgcaagtgatatttccgcatttctgaagtatacgaataaatacctgcttctggagcatgaagaaattgcccgctgcagcagtgaaggtattattatcaagacactggacggtgattttgtgaaacgcgatatccttgtgaccgatttggatataaaggatattcaaaaggatggctttgagcatttcatgctgaaggaaattcatgaggagccggaggtcgttaagaaaacgattgattctttaatgcaggtggatatgaaggacctgttgaataccatgccgaatctggcaaagtacaacgatattcacattgttgcctgcggaagtgccatgtatgcggggatgattgcaaaatctctgattgaaaccagagcacggattcatgtggactgtgtgtgcgccagtgagtatcgctatgcaaatccgatattcacggataagactcttgttattctggtatcccaatccggagaaaccgccgatacgattgcggcattgcagcttgcgaaagagcacggtgtggatactctggcaattgtcaatgttgtcggctctacaatcgccagagaggcgagctttgttatctatacaaaggcaggtccggaaatctgtgtagcgactacaaaggcatattgtacacaggttgccgtattatctctgattgcctgtaatctggcctatgttcatggaaatattgatgcagaggaagcggcacgcattacgaaggaactaaaggatttgccgcagcatatgcaacagctgatcgattccgaccagtacaaggcatttgctaaaaaaatatatgagcacaacgatgtcttctttatcggtcgcggtctggattattcactatccatggagggcagtctgaagctgaaggaaatttcctatatccattccgaggcctacgctgccggagaattgaagcatggaaccatttccctgattgaaaagggaacaccggtgattgcacttgcgaccgatgaggatttatatgagaaaacaatcagcaatatcaaggaggttaaggcacgcggtgcttatgttgtgctgttaatcagcgatgaccttgatatcgcttcggattattatgatgatgtgctggtgataccaaaggtggataagctgattcagggaatcctgacggtgatccctttacagctgatggcatatgaaatcgccaggcttcgcgggtgtgaaattgatcagccgcgtaatctggcaaagtctgtcactgtagaataaggtatttaacgtaagatgtgcgcttacattcaatttcctgatactacacacacgtttgcacatctgcggttaaatatagaaaagagggcatggaaaatgccctttttatgtgcaaatctggatgaagctttttttcattatccccaaaggattgatatgcagataattgccggtataggaaacatgtcagtcttagaagtccttcgttctcctttcagcgaaaagggatcataacgctgatttccgccacgatcccttttttagaaacaaaaaacgcaaatttcataatctgcttccggaaacacgccaattatgtgtccgccattttccttatagaagctcttcaatttctcgttaccgttccagcaatccagataaacaggctgttcatagcctttcagccaggtacagattgcctttcctatgcctgctccctgataatcgggatgcacagcaatacgggttgcatacgctgtatccttttcatacggctttatgcaaaaggaagcaaccacggtatggtctgacaaaagcacataggtaaacggaagctcctttataacatcaccttccgacatataggtccattggcgaatcccctttgcaagtaagaaatccgtacagacatgctgcagggctgttaagggcgctgcatgctgtggtgatgctttatgaaacaacagcttcatttagccaaggccagtgatcatgcttgccgctttgacgaacacatccagaatagcctctctggcatgaatcagcgggccatccaaaacacctgacattaacaggaatatcatgatgaaggatagatacatttcatattgcatcagcttgaaataggtttcctcctttaagattcccattagaatcttggagccatccagtggtggaatcggaatcagattgaaaattccaagaccaatattgatggatgccgttgtgccgattacctgaaacagataataagtgaattcatttttatacagcaatccaaagcgtatgaacagcatatacaatatgaccatcagaaagccgacgatgaaattcatcagcggtcccgccattgcggtccagatcataccgtctttcttattgcgataaaaatatggatccacctgtaccggctttgcccatccaaagccaaagaaaatcagggacagagttccaaacggatccagatgctttaggggatttagggtaagtctgccacgttgcttttgagagatatcacccagcttataggaaacaaatgcatgtgcgaattcatgcacggaaagtgcaatcgcaaccgcaggcagtatatagatcagattagcaaaaaaaccacgaatatccataaacattcctccaatagaatagtgttagtatatcatattttgaaggaattacaagtttcataaatgtcacccctgcaggaacagcaggtaacccttatccgtggcgcaaaccgtcttgccaggtatttttaactgaacagggattcctgtatagaatccctgtttctgattacatctgatcgatattcctcttgcagccaagatacgccatcacataataacagccgtaaacagcgaggaagaacagcatacttccccccagataaataaacatattcgcactggcataggtcatctcgaaaagctcatcaagcatacggataatcggaagcagatacacgataggaagtaccagcggaatgatgaaataaaccgcaatctgcttagccagtaatgcatgaagctgtctttgattcacccccattttatgcagcattgcgtaggaataccgctgccggtgagcatcggaaagctgctgcacggcgagtatggttgcactgatgcagatgaagataaaagacagatagaacagggagaagcagatactgacaaagcccactgcattttcctcaaaccattttgccttcacacgataggaggcatagctgtaaaagctgtcccctacctgctctttgttatcgtcaaaaaactgattgaccgtatcctgataccaggacacctccgtctcaggatccgtattcgccacccattctcgaaaatacggcttggcatgcttgacatgctcatccgcaacgataagataatagccactgttccgtgtctgtccatattccgtatcatctacaccacgtagctgcagacgcttcccctgcagatgcagagtatgctgtgcgccatattcctgcaggctatccttaatatctgttgcgcatacgatcaaatattcatcagccttcagcgttacagacggttttccctttaaggaacgaagcttattaaaatcgctttgcttcatataaaccgaatgcttttcatcctcggtataatagcttttcccctttactacagaatagaaatcatcacgctcttccttctgatagtaatgaatatccgctgactgatacgaaatcttatgttcctgcaaatagctttcaattgatttcatattgagcttttcactgctgcttgccatgatatcaaatggtacaaagcgtgcattactcagctccttcacctcattgaatttcaatgcaatacagagaaacagcagcgtcagcagtgtcagcagtgacagagtcgcaagcaccgttcggttggaacgcaagcgacccgctatctgcccgtacagatacatgcagtttcccttatatttgatttttctgtgacgattcagaaaaatcccaagcactgccgatatgccataaaagaacagatagacggatacgataatcgcaaatacccccagcatgagcagcatggaatctgagctttggccgtttaccatacttctcagatactgctgtgtcacatataatcctgctactgccagaaggacagctgcaaggaagtagaatccggataaacgagaaccctttgctgttttttcattcctgctcgcattatacagcatggtatgaatgctctgctttttcaaagcaatcccttccctgatcatctccagcagataaatactcaggaagcagagaaatgcagcaccgcatgcgctccaggagaaggaaagctgaaatgcatatgcaaaaccaaagatattcaacagtattgcgtgcaatatctcatagacgaaaataccgagaacacagccgataaaaaaaccgacagccccaagagccagctgttcaaacaggaacatacggctaacctgagttcgcttcatccccaaaagcagatacataccaaattcacggcttcgtttctgtagaataaaattcgatatataataaatcagccaggcgataatcagggttaccagaatactgaccataatcataatgcttttgacattgtcataggttgtaaccagatcctgcatttcaccggaaaaggcaatcgcgaaaaacgcatacagcagtgtcatcgtaatcgtcactgtaaaaacataaatactgtattccttcaaactccgtttcagattgcgaagtgcaagtttaacgtacagcatgcacatcaccacccagcagctgcatcacatccagtattttctgaaagaatgcttttcttgtcagggagccgcgatagatttcattgaagatagttccatccttcaaaaacaaaacacgctttgcataagatgctgaaaacgcatcatgtgtaaccatcagaattgttgcctgaagctctgtattcattctctgaaactgttccataagcagataggaggaatgtgaatccagtgcacccgtcggctcatccgccagaatcagactcggatcatgaatcatcgctcttgcacaggcacaccgctgacgctgaccaccgcttacctgatacggatatttttccagtatatcctgaatctgaagaatttctgccaatgcatttacctgtggatcaatctgctccgcccttttcttcaaaagagtcaatggcaatgcgatattttcctgcagggtcagagtatccagaagattaaaatcctgaaaaataaatcccagctcctttttacggaattcagccagctcattttcccgcagctcacaaatactgtttccgttgatttctatatttcctgcgcttacagcatcgatggttgaaatgacattcagcagggtggtttttccactgccgcttgctcccataaccgctgtaaactcctgcttttcaactgcaaaggatatatcattcaatgcctgtgtgatattcccctgatttccataaaatttttccacgtgggaaactataacaacactcatatacttcacgtcctctctacctgaagtatacaaaatatgcccaggtaagtgtaggaggtttccttacaggaatatgacagttctgtaactttatacatgggagaactccagactcatcacggttccctcctgatctgaatccgcatgcagatcgatctgcagtgatgtacagagctttttgcataaatacagacctatgcctgtggaatgcgaatgaatcagtcttccgttatccccggtaaagcccttatcgaatattcttggcaggtcatgttccggaattccaatgccattatcttttaccgtcagcacaacatggcgcgcatccttttgtattgccagacttaaaaccgcaccctttttacgcctatatttcactgcgttttcaatcagctgattcaatagaaaaatcagccatttttcatctgtatagacaagagcatcctgctcgggaaaacgaatcgacatagaagcctgtgtacacagatatttacattgcagcagtgcctcctgaatgcaggaggatagtgatacctgctggatacgaaaatccttttccacagattcacttctcgcataaaacagcacctgctccacataatgctccacgcgctccagctgctgaaacagctgtcgtttccgttccccctgctgattctcgatggacagcttcattgctgcaatcggtgttttgatttcatgtacccactgctcgacataatcctgatattcccggcgggagcgctgaacagtaccgatttcctccagcatggatttattaccgagatacaacagccgccggtaaaatgcctcttcatggtttgcccctttgggcagcatctcatgcatgagatagcgtttttccatggaatcgataattgcgcacagctcttttctgcgcctgttttttctgtgataatcctgaatgaaatacaataagaaaaacaggagccacattccgctcagcaaaatcgcaagtcctgccggcatgcctaagaaaacgagcagtacacactgcagcagaaaaaccagcagcataccggccatgagaattccatgatcctccagatattcatgcagcttcatatctgatatccctgccggtgacgtgtcacaataaaatcctccacccccagctcacgcagcttattgcggattctggtgacattgacactgagggcattatcatcgataaacagcttattatcccacagatagtcaatcagatcctcccgcggaatgatttcccctttatgctggaacatgtaatgcaggattttcacctcattctttgtcagttctcttgtattattttgaaattcaacacggctcattgcgacatccagcagaacaccatgatgtgtcagattctgatccttccattcataggagcgcttcagtagtgccgcaatacgggcaagcagaatacttgtattgtatggcttggtaataaaatcgtcaccgcccatctgcatactgcacagctcatccatatcggtattccggctcgtcacaaatataataggaaccttggaaaagctgcgaagctgagaacaaactgtaaagccgtccatctgcggaagattgatatccagcaggataatgtgtggatcatgcgttttcacaagctctctgatatcctcctgcatattccagcaaatcgcctcatacccctgtttctgcagcagcatctgcagttctcggcagattgcctcatcatcttcaattattaaaatcgtatacatacgcatttcctctcttttctgtttcatataggaacaacagctttataacacctaaaatgaaatggaggcatttcatatttcatccttgggatgctataagcctctcacccattatacaatagccgcaaggaaaaagaaaagatgaccgcagtcatctttcaatactgtaagaactaagcgtccccataggccttgttcactaatagatgtattccactgtatatgatggaaatcaccgtccagatacaggtggataccagtgctccgaatgtatccagatacacatcactcatcgatgatgtgcgaccggtaaatttctgatgatattcatccccgaaagcaaagcagaagcagataccgacagtaaacagaaaacgccagaatttattgacgcccaaaatcgccagtgtgatataaataccggcagccagtgtaaagtaaatggaaaagtgggcaagctttctgatattggcattccagtcactgccatagggagagtgcagaataacgaagtacttgatgcgttcacttaatgctattccctcttcggtggtttccagtctggtattcacctgttccttgattttttccgttacaatctcacttcgtgcattggacatctgtccgtcctctgccgataacgagtagattgcaaacataacggaaccgcagacccccagaaaaatcaatgcacagagaatgcggattcccatgttctttttcttcttcatacgctcaccaccttgttgccttattgtaaaacaaaacagatgcatacgcaagacatgcagttaaatataacaaaaatttaagatataccgttgatctgatttttcagtatgccttacctacttcatttcttcaacatgatctgtatgatgctttacccgcctgtctggttacattgtggagacatccaccttatcccttatgttcaagcataactcccctatctgatacgcattcagatcagatttaaaagctatgcagaaaaaaagggtatccaaaatatttggggggctaaactttaggggtcaatttaggggtctgaactttgagggacactttagggggataaatcccaaaagaaacaggtggcattcatctgtttctttttctataatgttctattggttatgcttctgtgaaggaggtaatcatggatcattcttatctatttaaattattaaacattcccgatgatggttctattatcatcaacgatgttgaaatcatcgctgataccaagtatgtatatatctctcgaccatctatcccgtcttattgccctaattgttcttgcagaatgcactcaaaaggtatttataagcgcaaaatcaaacaccctgtcttacaagacggaacttgcatcatctttatcgtgagccaaagaaagtggaaatgcactaactgttccacatatgttaatgaagatttcccattctttcagcgttataaacaatcctctgatattactcctctactagttttagaggctatgaaagaccttgatcgttctaccgcatctattgccagacaattcaatttatctgatactcaagttcacgatcttttcactgcttacgtggatttgccacgtttaactcttcctgagtttctttccgttgatgaagtacatattgatatttctgaaaaagagaaatatgccttgattcttatggactttacttctggagagattgttgacatcttgcataaccggtggcatcataccattgaaaactacttcttctccattccatacgaagaaagaaaacatgttcgttatattatttctgatgcatataagccttatcttgaattacccaagcatttctttccaaatgctgtgtcgattttagatagttttcatgttgttaaatatttattaggattgattaatacttatatcaattcagtaatgaaagcatataaagatagagatcttaaaaggcttgaaaaacaaaatcatgacaccaatagagacaataaaacgattcaggaatcacaagaagttatcttgcttagaaaatatcgctgggtgcttttgaagaatcaagacaatatcaattactctgacaaaaggtattaccacagctctcttagaatgtacgcagatacatatactattgaaaaactatttctctcactagatcctaagttcaatataatcagagatgtgaaagaaaaatatattagattcaataatactcactttagttctgaagatgaagtaatgcaagaattattaaaaatgattgaagaatttaaggctctcagaggttacattcctcgtcttttctcacaataccttgataaatataagcatgagattgcccgctcatttactataactgaggtatcaagacgtagtgcaaaggataatgagcgttactatgcacgtttatccaatggacctatggaatcattcaaccgaaagccgaaagattataagagaaactcacgaggttcctctaattttaattatactagaaatcgaatcttatggtctaccagaaatagacctgcattgagaaatacgcccaaatcatctaatgaagtacatagctatgttggaaagaaacgtggtaaatataaagtaaaagaataaagagattaagaatttgtacagaagcataaccaaaaaaagagaatcagaatgttttttcactgattctcttgattttaactttaggggtcttaatttttagcctttattttttctctcccccaaagttgacccccaaatttctggcgaaaacccctaaaaaatttggatagccgaaaaaaatacgtcctttaggaaatcggacgtatttttcatttcatatatttgatcccttacatactgtttatctgcagcttattttgttttctcgatgatttcaatgaagctgtctgccttcagacttgcgccaccgatcagtgcaccatcgatatccggctgcgccatgtattcaacgatgttgttaggcttaacagatccaccatactgtacacgaacattttcagcagcctcgtcaccatacataacacgtacctggtcacgaacgatacggcagcagttttctgcgatttccacagaagcgctctttcctgttccgattgcccagattggctcgtaagcgattaccatgtttccaacacattttggacacatatccgcaagagaaccagtcagctgatcacggattactttttcagaatctccggcatcatactgagcctctgtttcaccgatacacagaattggtgtaataccggcatcgatcaggcgttttgcctttttgtttacagtttcgtctgtgtcattgaacatttcacgacgctcagaatgtccgatgatacagtgtgtaacaccaacctcctgcagcataggtacagaaatttcacctgtgaaggcaccactgtcctcccagtggcagttttccgcagcgattaccaggtttttcgcaccggcaacagcagcagacagtgccgtgtaaggagcaccaataccgaatacggcattttcacttgcggcagcagcatctacagcttccatgaattcctttgtttccttcatggttttgttcattttccagtttccaacaataattggttttctcatgtctcgttctcctattttcgtttttttcttatttatctgcaattacagcgattccaggcaggactttcccttccatatattccagagaagctccgccacctgtggaaatgtgagagaatttttctgcgaatcccagctgaattgcagcagcagcactgtctccgccaccgattacagtcgtagctcctggcagctcggaaatagcagtacatacttccagtgtacccttcgcaaacggtgccatttcaaaaacacccataggcccgttccatacaacggtttttgcaccggcaagtgcttccttgtacagctcgatagatttcggaccgatatccagacccatgtagtctgcaggaatgctgtcattgtcagcaatcactgtgtttgcatcctctgcaaatttgtcagcacatacgtggtcaacaggcaggatcagcttgccctctgctttttcgatgtattcctttgcaagctccaccttgtcttcttcaacaagagacttaccaacattgtagcccatagccttcaggaaggtataagccataccgccaccgatcaggaccttgtcagcctttttcagcaggttgtccacaacagcaatcttatcggaaaccttagctccgccgatgattgcgacaaacggacgctcaggagtatccacagcagctcccagcatcttcacttctttttctaccaggaagcccagcgcattcggcagaatggatgcgacgcctgcagtggaagcatgtgcacggtgaacactaccgaatgcatcctctacaaacaggtcacccagctttgcccagtaagcagccagctccggatcatttttgctttcgcctttttcataacgagtattctgcataacgacgatttcaccgtcattcagtgcagcaactgcattttccagttcttcaccacgtgtaaccggaacgaaagtcaccttcgtatcaaccagttcatttaaacgctcagctacacagcgcagatcgttctttgctttatcttcttctgtcttcacctttccaaggtgggacatcaaaataatctttgcgttgttttccactaaatatttgatggttggcagagcctgaataatacggttgtcgtttgtaatcttgccatcttttctaggaacgttgaaatcgcagcgtacgatgacacgttttccagcaacatctaaatcttttacagttcttttggccatagtaaaattcctccttatgtatcggctttattataccaccaagagcctttttcgtaaacgaaatttcactttttgcgaaaaaaatcacaattctggatattttcaagaaaatcatatggaagctgcggttttctgtgtttttaggacaacatttatagtataatgtgaatacgagctaccatacagtaaggagcattctatggatacgataaaggaaaccatgcaggatctcatggatatcataaaaagatccaaaaacagcgatatggaagaggagtaccgctgttccgtaatgcttttgaatctgggtaaccagcagcaggacagctatgcccttgcatttgcccacgcctatcttgcggattattacattctgaccagacagcaggacatttgtcttcagcatctgcacgaggcgatttcctgttcggaagaaaaccattatgacgatctgctgcttatgtgctacacgattgccggattgtattacaactcgcattttgatgaaatcagcgccgttcagtattatatgaaagcctatcatattgctctggaacagaataatctgcatgaacagatggtgattctcaacaatctctgtgttctgtttatgcagaagaacgatacggttgaagccctgcgctatatccgcaatgcctatgaggtgtttctaaagcagcagacaccgcccgaagatcatgcacagctgattgttattctcaaccttgtggagctgtatatccgcaacggccagctgaatgaggccgtgaatatatatgctgcctatggaccgctgctgcatgaggggcaggcaaagggtcttcgtctgcatgtggctctgctgtgtgagctgtttctggcggacgcctttcaccgaagcgatgagatacagaaaattgcggattactttgcttccgccaagctgcatcatcatctcaaccgcagtatgtattttgctttctataatgatatctttgacattctgctgaacataaaggataaaaagcgctgtgaacagttcctgcagtatatgggggaaatttgtttggaggatgacatcgaacagcagctgcagctgcaactgagctggatcaacttcgcagaggtgtttcatatggaggatacgctcatcaattcctataagcagtattatctgctgcagaaaatggtggtgaatgtcaccaacaagaccaaggcggaaagtatgaaggaaaagattttgatggagcatatgctggaggaacaggagcgcatagtccgtgagaaaaatgtgctggaggcgcgcgtgaaaatcgatggacttaccggcctgttcaatcgcagctatttcaataccctgtgcgatgtcatgcagaacaatccggatgttaaagccatcggtatcatcctggttgatgttgactatttcaaggagtacaatgatctgtatggacattacaagggggatgagctgttgcgcagggttgccttgtgtctggatgaaaacggtgactcccgtttctttgcggcacgctacggcggcgatgaattcatctgtctgtgcgtcaatacagaaaaagaagaaattgaaagctacctgaaaagggtctatgaggatttaaggctggctcatatcgagcatgccacatcccctgcagcttctcttgccaccgtatctatcggatattccctgtttgataatgatgaaggctttgatttggaaactgccatcacgatggcggatacggcactttatcaggcaaaaaacagcgaaagaaaccgacacagctgctgcttatagactatgtaagaaatgaccgctgcctttatggcggttttttacaatacaaaatacagtacctcctttataatagcgtatatattctatgaaggaaaaggagtgtggtgatatgatagaatcacgttgcggtatcaaatgcggaagctgtgcttacaaagagcagatgggatgcaccggctgtctgcacatacagaagccgttctggggggaaggctgtccggtgaagagctgtgtggaagaaaaaaagctgcagcactgcggagaatgcgaaacgtttccctgtgagcttgcgaaagcgtttgcctatgatgaaaagcagggggatgggggagaacgcctaaagacctgccgctgctggaaagaaggtattccgggctgatggatgctgaaagcatcaaatccgcattacaggcaaaaaacggtgttgtaatggatttcaagctggagtgggatgcctttcgttttcttctgtttgataaaatgtttgccatgctgggattcaacaaacagcaggagccgattcttacgctgaagctaccgccgcaggagggtgcctggtatcgcgaggagtatgcgtttataacagagggctattatatgaacaaggtgcattggatcagtgtacgatacgatctggcctcccgggatttgatgatggacctcatggagaagagctatacaggctttctgtgtacgctgacaaagaaacagcagcagcttattgccgggaaagctcagcatacttagttttatgatattcctttgccgggaatatctttttagctattgattgttcatgtcttttgcatgtatgaatgcttttatttcatgccgatatgcataggcgggttctttttgtttggtatgtatatggacatatttgtgaatgccattcagaggctggaaaagcatgtatgtatataaaaaagacgcaggtaataaaataccagcaggcatgtgttctgtgacgattcatacaaaaaagccgttattctgtaggtaataacggcttttcttatgttatgtatcactttccaaattttttaacttcgataatgcagtcttaatatggttatgctgttcccatggaaaatttttataaatttcatgtaatctgccaaaatcaaattcaggaacacgtatgctcaaatatatattcagcttagcctttgttttataccttcttttcttaagatatttttcttttgtatcgatggtatctacaaacgtatttcccttctcaatcagcattgcatcatacttataatatggatatcagtaactatactttccctgttctgcaaattctatctgattttgttatggttgtaatctatttctatttatatcctatttcccgtaaagttaaaaaaagcggcgtggtttttccttccattccgctttccttatatatattggaaaatttattttactttggcatccagtgtgttgtccttcacaacaacatcatgtgccccgccttctacgatacttgtagaagacacgagtgtgattttggcatttttctgcagctcctcaatggtcagcgttccgcagttgcacatggtatgctttaccttgctcagcgtcagatcgacattatcctttaaggctcctgcatatggaacataggaatccacaccttccacgaaggacagctttttactgcctcccatgtcatatcgctgccagtttctggcgcgtgcgcttccttctccccagtattccttcatataggtaccgttgattgtaacctttttggttggagattcttcaaatctggagaagtatcttcccagcatgacgaagtctgcgcccatagcaagcgccagcgtgatgtggtagtcatgaacgataccgccatcgctgcagattggaacatagattcccgtttccttataatattcgtcacgcgctttcgcaacatcaatcgtagccgttgcctgtccgcgcccgattcccttctgttcacgggtaatacagatggaaccgccaccgattccgattttcacaaagtctgcgcctgcctcggccaggaaacggaagccctccgcatccacgacgttaccggcaccgacctttacactgtcaccgtatttctcacgaacccatttcaatgtgcgtgcctgccattcgctgaatccttcgctggaatcaatgcataaaacatccgcaccggcttcgatcaaagcaggaatacgttcctcataatcgcgggtattgataccggcaccaacgatataccgcttctgatcatccagcaattcatttggatgctccttgtgggaatcataatccttgcggaatacgaatgccttcaaatgctgattttcatcaatgatcggcagctggttcagcttgtgttcccagatcatatcgtttgcctcactcagtgtgcagccctcgttgccgtaaatgagcttttcaaacggcgtcatgaaatccgctactttggtggatggatccatacgggaggtacggtaatctctgcttgtgataataccgagcagctttccctccggtgtaccgtcttccgtaaccgccatagtcgcatgtccggtttcatccttcagatccagtacatcctgcagcgtagcatccggacggatattggaatcactgtatacaaagcctgcctttgtcgcctttacacggcgaaccatggcagcctcattctcaattgtctgagaaccgtagatgaaggaaatgcctccctctctagccagtgcacatgccatcttttcgcctgaaacagactgcatgattgcggaaaccatcggtatattcaaggaaagctccggttcttcctttccttttctaaattttaccagtggtgtttttaaagaaacgtttgctggggtacattctgctgaggaatatcccggaacaataagatactcactgaatgtacgtgaaggttcattaaaataatatgccattttcacatctccttttccatattcaattttttataaactttcccaattaaaaattgatattttaatacattataaagacattcacttttgaagtcaatatggttttgaaaaaattttcatgaatccggagaaccggtacagaacctgacggaaagcatatattttcttcccttcgtgaacagctgcatcagtaatagtacgactccacacagcccttcatttccccctcgttttttacatatctgccgacgcgggcaatcgcggtttcacagtagcccagtatttcactgcgtgtcagcttaccgcctgcgactgcacatatttcctccagcaatgcatcgcgcagctgccgcatggttgtactgccattcaggtatccgcttgcatcaaagtcaagattgtctctcatcacgacagcagtatcccggtttgcggacagcttgattaccggcacaatgggatttccggtaggcgtacccctgcctgtggtaaacaaaacgagctgacaccctcccgcagccatgccgctcatactgatgggatcattccccggtgtatccataatgaccagccccttatgatgaatgtcctgtgcataatcgtagactgcctgtatcggtgaatgccctgacttgtatatgcagcccagtgatttttcctccagggtcgtgattcctcccgccttattgccgggagatggatttcgttttcgcacatcatcgttaacacatttcatagcatcctcataatgacgtacaatctccagtatttgtgcagatacatgtgcattgacagcgcgctttgccaacagcttttccgcaccgataaattccgttgtttccgacagaaccgccgttcctcctgatgcgatgatgctgtccgccacttctcccaccagcggatttgcggccagcccgcttgtaggatccgagccgccgcattccatcgcaaccatgagctctgaaacgtctgcctcctcacgctgcatacagcttgcctgcgcaaccatttctcttgcacagcgaaccgcctgttccacggtatgcagagtacctccgcattcctgaatgatgaaggcttttaacggcttatcgcagcggctctgtatttcctctgtgacaagcttcatctgacagttttcacacccaagcgatatgatgatggttccatatacgttgggattggcagccatccctgccattgtccgcagcgtacattcctgatcgatcggtgtttgtgaacagcccagctgattgtgaaagctcacggttccctgtacctgcatcatgacctgatgtgccacgtcacttgcacatatactggcaggaagaataagcacatgattccgaataccgatccgaccgtcatttctgcgatatccccgaaacctcatatcagcacctccttctttgttttatatatcatcatagctgactcccttttatcttttggtattccatacattatgtacatgaacatgcattccctgttcaatatcacacgccgctatcccaatccattccccgtactttacaaccggttctcccttatgtattctgcaaagtgcaagcttatgataaacaggaatacattcccttacagcaactccctgttccatcccctgcgcatcggtatagatgcacagctcacctttactgatcggttcaatgacgacagcaacgttgtcccgttcatgtatacgaacagcatttttcatatgacctccaacattctcacaacaaaaggatgcacacattgatctgcttttttgcgtatccatacaaataagtgtacagtgtacttataaaatcacatatcatttgcatacatcccgttatggtattccttatattatagagaacgcagcatattcatgttttccacatagctgccttctccatgaaacaatgcacttgtcccaaggacaaagccgtcaacacccagtgcatgatattcctgaattacggcaggagaacatgctccatccagaatgatacgataaccgtacgtcttcttacatgcgatcagctcacggattttcgtatccacactgtcgataaatgtctgtcctgcaaagcccggaaacacgctcataatcaacagataatcacaatgcggaagcaattctttcactgcactcagactggtgtccggattgacggcaagaccggaaagctttcctctggaacgtatatacatcagtgtcttcatcgcctgtggctcagattccggatgaatatagatcaaatctgcaccggcatctaaaaaccagtcaattttatcggcaggatgatcgatcatcaggtggacatccaccatttttttcgtcagagcacggactgcctttacatccatcagccccatggagatattcggcacaaagcttccatccatgatatcacaatggaaaatgtctgtccccgcttcctctaaggcatggacttcctcttccagatttgcatagctcgcacacatcatactgggacataatatcatgacgccgccgccttcattctccgcaggttctcctgcagatctgcatcctgcctgaataatccgctggttcctcccgtcagtatgctggccccggctgcacatacctgcggtatggtccccgtgtggatattgccgtctgcctgaatacgacaggataagcagtttgcggtaatctgttccttcatactacggatatgttcaacggcttccctttgcatatgctgtccggcatatccgggctgtaccatcagctttaaaatccagtcaacctgtgatgccagcttcacaaaatcagaaggcacctctgtatcacaccgcattgccaataccggacggcagcccgcagagcgaatatgtgcaaagatatcctccagattatcgtcaatttcataatgcacagcaatgtaatctgcccccgcccgggcaaacggttcgatatagggacgcacgttctgtaccgcaagatgcacctctattggcttatcacagatgggacgtattttttccaatatcaaatcaccaaacacaaagcagttattaaacataccgtctacaacatcataatgcacaaaatcaatatcggaagcattgatctgcgcaacggcatccgatacatgcaacaggtctgcacaggacagcgatgcacttaccagaatttttttatcctttgaaaccgtacgcatattatccaaacagaatctgcatgatgcagatgttatcccgattctttttgatttcatataaatactgctttacatgttcaacaaccggttcatttccttccagggaattgatttcacagaaggtggtaatcagatccttatccattttcggctctgtctttccctgcagctcatcccagtaaacaagtgccgctgccgcaacgaattccataatacgcggatccttatcatgatccagtaaaatctgcatcggtgacataatgcgttcggtaggtcccagctttcttgcaggtgcacgtccgtttttgatattgtaatccagaatactcttatcccggaacttcgcaagagcacggttggtgaatgcctcctgatcctcttttgtaatctggaaataatcctgtaatgccggattcagctcttccatcagacgcatcatcacagcatcgatatccgggtcacaggctgcatctccgtaaacctcatatcccttgatataaccgcaataggaaatcagtcctgccagacagttataggtatagattttgcgtttgaagaatttttcaaagttgtgaattggcacagctccttcaaagtacagttcttccagctcatccgcatcaaacgggaagtacgcttcattcatggacagaatatccagccgtgtgtcatgaacactgactgtggaacagaagacggctgtctgtgtcaccgtgtagtccccttccacaccggcttcctgtaaatgtgttcgaagtaccttagccggattgataccgttttccgctgttagaaagacagtctttttctgcttgttgcgcatacctgccttgacctgctgagcaacatcccccagattttgttcaccggtggaggtcacaatgaaatcggcgtcctgtattgcccggtccgcttctttggaataggtgtgaaatgcctgaaatccgttcacataaatcggtgtacggtccttcttataaaaatggatacagaatgcacgatcctcatccagcatacggatcagtttttcatttttatcgataaaggtgatcgcataatctctttgaaacagaaagcgggttacatagccgcggccggtttgtccggctccgataacaactgcctttttcatgcggatgctccttctttgatccagccctttgccttcagctcagcaattgcctccttgatcagcactgcgatttctccctgcggatcaatttcagaaatcgtttccagaatgtaatcaattccctttgtttcacgtatttccttcaaacgaagtgcatcgcggtcctcaggattgtcaaaatacaatgcagcggcagcaccgagtgcaatcgcctttggcctgatacccgcagacagtgcgatacgcatcggcccgataaagcgatcctgcggtcccagcttacggatgggatctctggcaatgcgtgtaaccagatcgacaatagcgcggtctgtatatttcgcttttgctgttttggaaaatttgatctgactttcctcattgattcccattccatgaatcagtgcataattgatttcttcataaacctgatccagaataggctcgatttccggatcattggcggaatctgccacataggtcagccccttcagctttccgagataggaaactgtcgcaacacttgtattgtttgtatagattttctgttttagcagatcaccgaagtcagttacaaactcaacatagtcccattgcggaatttcccctttgatacgatccctgtcaattggcagataccgcatattctgtacccaggtatccatctcattcgtgaccttatccggatccggtgccccggttccggtacacatgatgacagattcgctgacaccgacattctcttcaaacagcttgcgttcctcttcgttcagatttgaaacaatcgcttcctttaaatcctttgccggatcaatccagttttcacaggtaacaatattggaaacatgcaccgcattttcctccaccagccttttgaacgctttggcaagtgtttctccgacatttcccatattttttccaccgcatgctgtaaacagaaaatccgcttccttccagcagctgcataaggcgtcaatatcataaaagagatgtgcctgaacaccttccatatgtgtattgagctcttccgcccccagaacatgtatggtatattcctttttttcatttaatttatctaccatgaccgggcttgcgtcaaaataggtgatttcaacctgattggcatgcagcagctcgctgacaaagcctcttccgatgcgcccggctcccagaatcattgctttcaaatgcattcctccttcactgtgtgatctacacgttatattaaaatccctgctaaggatgcctgatcaacctcatgcttcctccagcagtctgatcagattatccgttgccatttccactgtattggactctgcctccaccgtacgtgaaccgatatgcggtgtcagtataaagttatccatatgaatcagctcctgaacccagtcatcctgaactggcggctcacttgtgaatacatcactggcagccgcatagatcttcttattcttcaatgcagtatacagcgctttttcattgataataccgccgcgtgccgcattgacaatgacagccgtttccttcatcatatcaaactgttcatcggatatcatattccttgtttcctctgtaagcggagtatgaatggatataaaatcagcactctttaaaatttcctcaatgctgcactgctttgcctggtaggtgtccagtacctccttagggatatcgaatacatcataggcaagcacttccatgccgattccatgtgccatgcgtgcgacatgacgcccgatatttccaaagccgataatgcctatggtctttttcgtaagctcacgaccggtcggtttgttccatgctcccccgcgtacctgcacattgctggataccagatgtttggcagcggcaaacatcatgccgatcgtcagctcagccaccgcattggaattggagccgacacagcggcccaccttgattccacatgctttcgctgtttttaaatcgatattatccgtaccgacaccgaattttacaaccgcctttaagctcctgcattcctttaacagttcgccatccagctcatccacaccaacgatgataccggtgctttttttcgcatattccacaaaggcttctctggacagcggttttcctgtggtattgatattcatttcatagcccagtgcctccagacgttttgcggcctgcgcaccataggctgcatagccccgcggtgtaacgagaataactcccttgctcatatcagtcagccttcctgctttcttccacaatagcacgcagttttcttgcattttctgcgatatcggcactgcttccctttgtcagaagtccgcccagaccaacactgtccacaccgttttcaaaccaggtatgcagattgtcgaagtttgctccgccgcttgcaagaatcggaatctgcggacatggcaccttgaacaccttggcaagattcggtccatagtaattggatatcgggaatgccttgataaaggacgctcccgctttcaatgcttcgatcatttccgtatagctcgtgcagcccggtgcatagggaatctgatacagattcgccatctcctgtacctctttgttgaaggtcggagcaatgatgaattctgccccatccatgattgccaaacgggcagttgtcggatccagcaccgtgccggcccctaccagcagctgatcaccaaatttttcttttaaagcgcgaatgacttctcctgcattattattcgtatagctgatttccagaacatccacaccgccatcgatgcatccctgtgcgatttcaattccgcgttcaatggtttccacccgcacaattcccattaagcctgtttttttaattctgcatattgtttctgccaacatttttttgacctcactttcctgtcgtctttgcctgatacagcgttcgtacacccataagtacagcaatgcagcctccggcagctgctgttatcgtttctatcgtattcgctgtctgttgaaaaacaagacagaggaataatccgataccgatgaatagaaacaacagtgcagggaatatgccgccgctttccttatcccggtgttctttacgccatgtgatatgcttccctcctgcccgatgcagtgacggaagtaattttttattcattatgagcagctccactgcatacagcacaagggccagtgcaatggtgcccgcaatcttatgaaacagaaaataccctaaaataatactgatggaaatggcgttgatttctgcgtgtttccacagagtgatcgcaaattccctatgttgcgggagaagataatacgcattcttctttttgatatacagcagtcttcttccttttgtatctgttcctgtaaacagcatccatcctgttaccattctatcacctcaatagtttttaaatatccagcgccttgcgcagatttacaatcgtatccctgccgatatccgccagatgcgttgttaactgatccagctccatggaattacagctggacagagcctccattaaaaacggcatattaacaccggtatagcattgcagcttgtgtgcttccttcagctcgtcgattgcaagtgccgtcatattaaacggggagcctgcgaaaatatccaccagtaccagtacaccgtcgcctgtatcaatcgcttccaccttttcacaaatggcttccttcaaatcttccggattatccgtcggatacagaccaatagtttccacatcatttgacatactgccaaagaacatggcagagctttccttcagtgcctgtgccagaggaccatgtgtcacaattaaaatcttgatcatactgtattaccctttctcgtcgtttgcggtttcatgacgcaatataaagtgaatcggcaggaagctttttcttcccgtgcaggaatatacgaagagcatatggcaagtttcctgccgatgattgctatatatgaaaggattgttaaattcctttcaaagaatttctatccaagcagtccgactgccccgccgataaagccgatgacaaacagaacgatcagaaccgttgtgattttctttccctttacctgcagccagtatgcaaacagggttgttacaagcggcaggaagcaagggaagatcttattcataatttcaccaagattcagcgtgccggttttcatttcaatttcaagaacagcaccgatgctgacatattttacaatcatggcacccagacagaagagtccgacgataccaaggaaggtggtgattttcttaacgaagccgctttccaggaaacggtcaatagaatccatacccagctgatagccgcgcatgaacatgaagtaggtaactgcaaagtccagcagggtaacgccgataccataggcccatgcgccccatacatatccctgcatagcccatcccagggttacactcagaataatcggtttgatcagacctgcccataccgtatcaccgatacctgccaaaggtcccattaaagcagtttttatttccgcgatgatgcttgcgtccatttctccggaatcatcattcgcaagaccttcttccagagcgactaccataccgggcaatacagctccccagcgtggctctgtgttgaaatacagcatgtggcgttccagaccctccaccatcttgtcatgatcattcggatacagcttttcaaaaataggacccatgatccatgccagacagcctgcctgtaatcgctgatagttataggtcatatgacttgtcatgtgccagaagaaggctgttttctggacatcgcgttttgttagtgaatgtttttctgccatgattattcagccccttcctgttctgtgtcgttgttgaatccaatcttaatcaggataactgccagacatacaccaaccagtgcatacagcagcagatcggtcataccggagtaagccgcgataccgaagcccagcacgaagaaaggcagcagcgcttttttgtacatgaacttcatcagcatggacatacctaatgccggaagcattttaccgacggcagccagaccgttcattgcccatgtcggaatactgttgatcatggtctgaatgaattcactaccgtataatgcaatcaggaataccggcaatgcacgcagtaccagaacaatggcaggaccgcctaagaactgaattctgcgaataccgcgccagttacccttggcagcgagcgcatccattttaaccggccacagggatgcaattgtcatatatgcgacatgcacatagttgcccagtaacccgataggaacggcaaacgctacagacgtgtcgatggacataccgccctgaatcgctacaaatgtaccgagcagacctgcccagtataagtcggaagcatttgctcctcctgcagaaatccagcccatataagaaacgttgattgttgcaccgatgatggttccctgtacgggatcaccgtaaatcagacctacccaaaatcctgccattaccggctcacggaagaagtaccagtgatatggtccctgaataccgttgagcagtgcaagcagccccattaacaatgcttgtaccatgaaatttcctccttttcattgtcaattcctctactacatctctttactcttgtcatacagatacgatatattcatcacctccatgtgatcgaattctatcggatacacagctaaaatttcgccagagcatccttgaacggatacggattgtcttcgggaatcggctgcatgaaaatatccacgccgccctgatacaagacatttaactcctccgcttccgttttcgacattaccacatttttataaatattcttcttatcaccggagccttcaattccacctacctgtaaggaagggaatttcacacctgcttcccaggctgctttcgcctgtgaagtatttttaaacagaatcagcagattgttttttggaaattcttgcgccttccatttttcggcagcctctgcgacattccataccagaacttttacaccgcttggggcagcaccgaggagaatttttttcagaatcggactctttgcggagcgatcgtcaattacgacgatgctttcaatttcatattttgccacccagcgggtcattacctgcccatggatgagtcgaaagtcaattcttgtcagttttaggttttccatcatgttatccttctttcttttgcgtcttttttacgattacttcgcaagctctacaaagcgcattgctctgcgggtcagctccgcataattgccttcctcgcggcattttttatctaccagctgggagctgataccggcaccggtgaatccaagcttcaggtattgcacaaaggtttcttccgtaacgccgactgtcgcaatgtatttcacatgatgcagcggtgcatagatatccttgcaatatttgatacccagtgttcctgccggaaacagttttatgaaatcggcaccggccttatccgctgcgacgatttctgttggtgacatgcagcccggcatggaaaccatgtccagagccagcgtttccttgacgatttcctcatcaaagttgggagaaacgataaatctggctccggcttctttggcattgtgaacctgttcctttgtcagtacggttccaatgcccagatacaattcatccccaaactgtgcatgcagtgcctgtatgttctctttcacctttgtacacgtatcgggatcggatgggtcgtatgtgatttcaaaacagcggatgcctccctgaaacagtgcatctgccagcttcatcaagtcatccccgtaaatccctcttgttataactacaattttctcttcttcgattttttgaatcgtttcctgtctgctcatacacatttcctttctataatccattgataatctccaccggccgttctccccgttccatgcagtagatatcttccattaccttgcggttcatgttcttcatgcatgtatagttataaatagcagagtgcggcgtgatggttacacgttcgcacgccagcagaggatcatcggcctgcatcggctcatgcacagcaacatccgcaccatagccaaacagatgtccgttcctgagtgcttccagcaaagctgtttcatcaacgagtccgcctcgccctgtgttaatcagtatggtgttgtccttcatctttgccagtgtctgtgcattgatgagatgcttacttttctcatccagactggcatgcagactgatgaagtccgattccttcagcagggtatccagatcacagagctgaatcccctctgccatgaccttttccttgtctgcatacgggtcatatgccagtatgcggttctggaagccatatttcataatctgtgcaaagcgtgtgccgatatgaccgcagccgatgacaccgcatgtctttccgcgcagctgaaatcccatgatttcctgacgatccctgttccagtcgccctgatgcaccttgtgattggctgtaaccacgtttttcgatactgccataagcagtgcagcagcctgttctgcgacagcatccagttccacatagttttggatatgggttacatacacaccgtgctttttcgagctttccagatcaacgttattgaaaccgatgccatgacgggcgatcagcttcacatcacaattgttggaaaagaatgtttcatcaaaggttggataattgcctaatactatataggtatatcccttcagcttctgggcgagtgtcctgccatccatatctgccggcaacagcattttatcaaccggtccgaccttctcttccaattcctgcagatgctgtgggaattctctgccaaagctggttatattgataactgcagtttttttcaaatttatcacccgactttcatttcctttctcctgcattctgcggcaaactgagatcagccgccttacactatccatgatattgaaaacgcttacgatgtcaaactgttcaatttaagcctagtgtgtcacacgtttaaattcctattttttctattttatcggccctttttccaacgaatcaactggtaacttatggaaatcgcaacacaaaataagctaaataatgttactgtgttatttttcgcaataaatagcacagtattgaatttacagtgtgtatatcaaacttataatttgacacgaaaaaaacgcacaaatttgtaagttcttatatttgctacatcctacatataaaaaagcccaaaaagaaataaatccttttgagccactgacaaacagttaattttaaaaaataatttttttcatatatcatcataatgaaattccaaggctttttttatagtgtgatataaaacctaatcttataaagtaccaatcctaatctatttctttaatcacatatggctgcgtagttctatctggtataaaaagtgaacaataataatactcttctacagtctttttatcagaacaataaacaatagtatacggttttcttcatcatctcctcttactatataattaaattcaacaaagtcctctttaggatatgcaatattccatgtaagataaaacggtctttttttatctgtcaaaacagctatcttgtgtaattctatttcatctactatgggagtatgaaaagaattaccatgacctgtaaaccaggcataatcattatgttttttccatgagccgataggaatatttttcatttttaccaattcatctttgattgctataaaagatcctttatgttccttaaatgaaggacatacgcatcaatttcattcctattcaccgataaaaataacggaatagaaaataagccatcgctttgcaactgcagaatggcttttatttcttccagcgtattcttattttgtaaagaacacgtttgctgtggatagcagaacactttatcgcatgtcaaaattataagtgataagatacgtcactcttgaagagtttaagaaaactggcgttatcagtaaaagtgatctaaaagaatatgtaagtgtatcatatgaaagctatattaccagtcctgaattgctttacgaaaaagataaagtgctatatgatttctttgataagagatggttggtgaataaaagtgaaggcagaaaatgaatctgtatacagaagatatacgtgaattgataaaggaagaatcacgtataatagaagatttcgaaaaacacaatgctccttcagaaataattagcgagaaggaaaacaaataaacagccaccggtaagattttttaatttattagtcttttgattatgaagagaaatacggattgctttattggtttgaggagggtacggaataatctggatagataaaaaaggtattagtgattatcatgcctcttgtgtaacagcatggattgtaaacattacaaagcaatgggaaatatgaagcctatttgttctgctttcccataaaggtattccgaaagctgtatggactgggactttactgcacactatgccgataagtggtgatcatggactccaatatgagaaagcgaaaatagaggacacagatttaccggaattattatacgttgaagattaacactcacagcgggtgctttcaaatattaaaaaaacctaccactacagaatggcaggttttccgcaatagtccccatagggttactaccgcttcttcgtattcacatcttataacttttaatttgaattatcaagaaaagaggatcacccttaaaaagtgatcacccgcaattctgctgggtacatccggtttccttgtctgctttcatttttaattacaagtcgctccttccaaaaaaacgccctttatgtttgtggcgttttctttaatcgctttattgtgcataaacaatctacacaatacggttctgttccttcccctgtaggaagcatctcagattttcaacggcagtatccataattctgcgcctagcctctttgctagcccaggagatatgcggcgttatcaggcagttatcacattccagcaacggattatcattgcggatcggctcctcccttaccacatccaaagcggccgcataaatcgtaccgttttgtaatgcctgcacaaggtcatattcattgatcagctttcctctggcattgttgatcaggatggcatttgatttcatcatagccagcgtagccttgtttatcagggaatcattctcctttgtgagcggacaatgcagacttaccacatcgcttcgccgcagtaattcctccagagaaaccttttcagcatgcgtgtcgttgtcggcatgggcgtcatgaaacaggacatgcattcccagtgcctgtgcgatttcagcgaccttcctgccaatgcgcccaaatccgatgatccccattgttctgcctgacagctccattagcggatagtcccaaaaacaccagtccgcattgtttgcccattctccctcctttacacgttttgcatggtgcccgattctggatgtcacctccagtaaaagtgcaatggcatattgtgcaaccgtatccgtaccatacccgggaacattggtaactgcgatatggagatctcttgcggcttcgatatcgacaacatcatagccggttgccagtacaccgatgtaacgaagctgcttactttcctgcatcagctctcttgtcattggcaccttattgataatcacggcatctgcatcctgcattctttcctttacctgcgagtgatccgtgcgtgcatacaccgtcaaatcaccaagcgcctccatccccctccagtcaagatcccccggattttctgtataaccatccaaaactacaagcttcatatacatatgtaaaggatgccagtcagcacccttatctcctttccctgatcatattataaaacactttacaagctgttgcgataaatattcttcacatcctctgcggacagtgacacaaatccgttcaccgtctgttttgcggcatcctgtgccattgcatcgaagtgcgtatcatcgatacccagctcccctaaggatgagcgcagatgcagctgtttataaaagcttcgcagacattcaattccctcccgtgccatatcccacgaatccttttctgttacctgccagatttctctggcgaaacgcgcaaacatatccactgtatcctcgctgagaacatactccatccagtgcggcgtcagaacagccagaccttcgccgtgtgtaacggaataaaaggcactgagcggatgttccattggatgaacactccactgtgtcatatgccccagcttcagcatatcattgattgcccagcttgctgcccacatgagattggctcttgcttcataattatccggctcctttaaaacgagcggtccgtatgccgtacagattttcagtataccttctgcaaaccggttctgtaaaccggcatcctcccgtgcaaaataagactccatcgtatggctcataatatcagccacaccacaggcactctgatagcggtttacactaaaggtaaaggtaggatccagtatcgcagcccttgggcgaaggagtggattccgtgtacctattttctcttttgtatccggattcgtgataacagcaatatgatccatctcactaccggtagccgcaattgtcaaaaccgcaataaccggaatcgctttttttatttcctgcgggtgaagcaccagctcccatggcgacaaggtactgcatacagcggcagacacaaccttggcacaatcaatcacactgcctcctcctattgccacaataacatccacattctccctgcggcataacgccactcccttttccaccgttgtaagggacgggtttggctctacaccaaacagctccacatacttctttcccgccgtatgcaattctgtaaccgcctcgtcataaataccgttacgacggatactgcctcctccgtaaacaagtaagacccgctctccgaattccttcataatggtatgaagctgctgcagctgtccctttccaaaatacacctttgtcggtatatcataaataaaattttccatatatcaatcgtagaagccggacatgattttgatcagttcatccacatcttcggtttctctcatcctccgttgtctgttttcttcaaactcctgcagatattctgctttttcaattacctgatctatgacggatgccggaaatttcactgctccgttttcatccatgtgaatgatttcccccggactaacctgcatcccaaaaacctccacaccggtattcacggactgcactgcccattttccatgacctgccgtaacaccgcttaacacgtattgcatctgcagcggacgtatctcatccacatctctgctcggaccgtcactgatgacaccgacacagccggcagaacgaagtgctgtcatcatatttccacccagcaagccgttacgacacttaatctcttccggcatgtcctgtttcacaatcagtaccactggttttccgacagcagcaactgcttttaacacatctgcgaacttcaggcactcatagttcggatccggaagaccataggtacacgtaaccgcatagccaacggttctgcctagctctggatacataacccttgcgcgctcatccgtataccattgtccgcgccagggatgatacagtcccagacagtactccttatccggataggttgcgaccacattggtaatggacggtgtatcaaactgcttcagcttttccagcctatcatcaattttcatgttcatcctcctatatatgaatttatttgaaacaaaaagcatatcgtatacattcttcaattacccagcggctactgacagccgaaatatgccagcacatgatcaactgcgatatccgacatgcgattgattgccccttcactgcttgcggcaatatgcggtgtcagaacggtattctcacaggcaatcagctcctcatcaaagccgggctccatataatgcacatcactaccatagccgtaaagctgcccattgtgcaaagcatcatacaatgcctgccggtcaatgagctttgcccgtgccgtattgatgataaccgcatcctttttcattttggaaaaagcctttgcatccagtagcggtgaaaactctgcaagtgcaggaagatgcagcgtcagaaaatcactgctgctcacgatctcgtttatatccgccttgtgtatgccatactcccggataaacgcctcatcataatagctgtcaaatgcgagtatattgcaatcaaaccccttcagtcttcgtgcaacggctttcccaatggcacccagcccaaggataccgacggtgctttgatacaaatcctttgcaatcggctttttccacacatgcgagcggatattggcatcacttcttgtaatattgtgacaaagagaaagcataagtcctatggtgtgatccgctacggagtttgtatttgcattgcgtgcaatttgtaatgcaatgcctttttcctttaaatattccacatcaattttatccagccccacaccatagcgtgaaacgattttcaatttatctgcatgatcaatgacattgcgattgaaaacctccgttcctagaatgacagcatccatcccctgaatggcttccaccatttcctcctcattcagcagtcttcccttttcatttccatagacctcaaagcctgcatcctgtaatctttgtatcggtttcctacttaatttaccaaaagacttggatgttaccaaaaccttcataagcgatttcctcctgtattttcaatattgtccggtaaatgtttttataccaaatcgtcttaactgcaaaatgcttttccaataaacggaaatagtcaaacatcaacaccggcggtgtcatgtcatatgcagcaatgtcttatccggattaaaaagataaagcggatgacagccggctccctctttacagaaggcagcaatgctttccattacttgccctcacagccaaacagacggatatagtgcttgattttatgtttgaatccctccgcaagcagcggatacagctgataaacggcattgccgctcaaatcctccttaaccagattttcaatcgcgctgcgtttcaaatcattggacaaattgattttattgataccctctcttgcacagcgtgccagattttcatctccggtaccgctgccgccatgaagaacgagcggaatatccagtgcatccttcaattcatgaagaaggtcaaaatgaatctgcggagtacctttatatacgccatgtgcagtaccaatggcaaccgcaagtgcatccactccggtctgctttacatattccactgcttcctcaacacgggtaaatgcctgatgtccgtcagtatgatattgctcaccaacacctacatgaccaagctcagcttccacactgattcccagtgcatgacaaatccgtaccatctcctgcacctctctgatattttcttcaaacggcagtaaggatcggtcgatcatgatggaggtatagcctgcgcgaatgccaagcagacagtcttcaaaggttttgccatgatccagattcagggcaatctttactcgggagcgtctggcaagatccactgcaattcgtccaaagctttccagatccggattggcaaccggtgttgtattcagtataattccggtattcatttcttctgccgcctcgatggcagcacgcagattatgttcattatcaatattgcaggcaggcacggcataattctcctgctttgcctttgttagaatttcctttaatgttaccagcatatcagttatcttcctttccgtaattgatcatgacacggtaaacacccggtttacatgcataatcaaaggcttcttttccctgtgcaaagctgaattcgcggtcgatcaccttctccatatcgatcatttgataaccgatcagcttgaccgccatctgattatcctcaatcgtcggattcagcgttccgataaattctatttcacgactatgcaccatgccgaaatccacaccgattggttctttgctgttttgtgagctataggcaatcagtctgccatatggtgctaacatgtcaattgcctgctgccacacctctttgaacggtatggtgttgatgacagcatctgcccccagcccatccgtcagcctgcgaatttcttcaccgacatcacattgacgcgggtcaaaggcataggcagccccttcccgaatcgccgttttcctcttttcttcatcggtttcactcacaataatgcgtgcaccgcacatctgagccagcttcacatgaaagtaccccataatgcccataccgataatgacaaccgtatcaccaaactttaatcttgccttgcgtatactgtgaatacagcatgccagaggctctgttagtgccgcatggcgcatatccacatcatgtggcatacggataatctgccatgcaggaatcaccagatattcacttaagccgccgcccagtatattcccatccagacttgagcgtttcggcatttcctttttgcgattgcactgcgttcctctgccggagcgatccagctcacactggttacaatatccggatgtaaaaattgctttatcgcctgcctttacacctacaacacctctgcctgtctttataatcgtcccgctgcactcatgaccgccaagaaacggatatccgtagttccttgttcctttgtatgttctgcggtccacggtgcataaggaacatacctctgttttaaacagtacctcataatcccccggctccaggatatccagctcgcgcattgccagcttatcctttgcttcaatcacccatgctcttgctttttccataggattctcctctcatgtttgttattcctatctatatctgaaaagaagcagttttcttcacctcctgaagcttctacttactgaatctttatctgtatctgacaactataatcatattgaaaacgattacagtgtcaaattgacacaaaaagcaacagtgtgtcatcataataagacagctaacggagaaaaacctccacaaagtaatgaaatcatttacatttcatgcaaaatcataggaagtatgtactttttatatggattatgttaatattttcctagcttgtgtgttatttcacccattgatttaacacgaaaaagtaacagggagtgatagtatggcgaaaaccagacgggatctgattatgaatctggtcagagaatacaccagtgaaagtcttgcggacaaatccttcagctttgaacgatgcaatgcctttgatatcgcattggatctgaagctggaccggtccaacgtatccagaattttaaatcagctgtttaacgatctacagctcatcaaggtggaaggaagacccactctctatttatccaaggatgttattgtcggcgaatatcatttcaataatattccccaaatcatccccggaaaagaaaacctgaaaaatttattcgtatatgatgcaagtgatgccagtttttataaaaaaggtatgaatattattggaaacggttatgaggaatcactgacaccggttatcagtaaaatcacccctgccatattttattatcagaacaagccgttactgattgcattacagggagaaaaaggctcaggcaagaaatatttttgtaaaaagctcttcgatctggccgtacagaataaacgtatttccaaaaagagcagaagcttcacctttgattatcgttccataaatgaaagcttttccactctgcggcagcagtttcttgatcgtaatatctccatggtcatcatggaaatctacacaccgtttcaggaaagcgaaatttaccggttctggaacgatctcaacaatctttgcagcaacgaaaacaagccgttacctatcatgatttttctgattgataagagtgttgaaaactttgcatatttctcacagctgacaccttacacagcgaagtatcccaatgtaaaagagcgcacaacaaaagaaatgattgagcttgtgctgaccttcctgcaggaggaggcagtgaatctgaactgccgcatcaaggtgaccggaaatgcgattgcctcctttctcagcgcagattatacctacaatctctttcagcttcgcaatgagattgtctattccctatccaataatctgtattccagtgtgattaccaatcatgaaccaatcgtcatcacacatgagaacatatccaagaatgtcattcaaaacaagagtgcagataattctttggaggatcatatccgaataaccgttacacagctccttccggaaatcatagatatctacccggatcagccgtgtgaaacactggaaaatctattacagacacagctcaatgcaagcattgttataactgcacagctgaaaaacatcatagaaaaggcgaaagaggatgtcctgatgacgcggacaaagcttctggattcctcatccatagagatgcagtccaaggtctatcaggctctgacaccattgtttacgaaaacaaaattgaaaaatgaccgccagattttaagcaagctgtatatccagattcagcatatgctggataataccttcgcctaccagtttcagctggagcatctggattataaggaaacagcatattcccaggagctgagtgacaatgtgatcagcacagtggaaaacaagttcaacatcagtcttctgaaggtatataaaagctatatccgcaattttatctactatgcattaaaatccatcagtcagaataccatcatgacactgattgtctgtcacggggagcgtcttgcggaaaattatgctcagcatctgaatcagattctgggaagccgctgtttcttctcctttgattataatctctattatcagacgcatgactttcatgagtttacggataagatatataaactgatcaaatatattgatataggaaaaggcgtacttatcgttggtgacaagccgccgcttacgacattggataagtccatcatctccacgttaaacattccctccttctccctgtatccggtttctcttccactattatatgaaaccagtgaagtggtttcacagaagaccatgcatctgttggctctgctcagtgatgtagtgaaccgaaagaaaaaaataaaggcatttttgaatgataagagtctgacctctaaaaatgagcgtcaaagcagcgatatctttcagcgctttcaggcaaccttccctaccatcaatatagcaaagtccaatgaagccctgtaccgcgtacttctcaatatttgcacggaatgcaatttgccgctttccaataacatcattatacagttcctgtttcacggcacctgtatgctggaccgctgtgtgaagaagcagaaaatccgctataatcttttggaaagctttatgatggagcataccgagctgtttcacatcatgaaaacgaatttgttgaaaatccgggattttatgacactttccatttcacaggaggaaatcgccgttttgtgtgatgttatactcaattatcagatggagatcaatgttcaaacagagcgaaaataatgcgatccctctgacattcaaacattgaaaatggctatccaaattttttaggggttttcgccagaaatttgggggtcaactttgggggagagaaaaaataaaggctaaaaattaagacccctaaagttaaaatcaagagaatcagtgaaaaaacattctgattctctttttttggttatgcttctgtacaaattcttaatctctttattcttttactttatatttaccacgtttctttccaacatagctatgtacttcattagatgatttgggcgtatttctcaatgcaggtctatttctggtagaccataagattcgatttctagtataattaaaattagaggaacctcgtgagtttctcttataatctttcggctttcggttgaatgattccataggtccattggataaacgtgcatagtaacgctcattatcctttgcactacgtcttgatacctcagttatagtaaatgagcgggcaatctcatgcttatatttatcaaggtattgtgagaaaagacgaggaatgtaacctctgagagccttaaattcttcaatcatttttaataattcttgcattacttcatcttcagaactaaagtgagtattattgaatctaatatatttttctttcacatctctgattatattgaacttaggatctagtgagagaaatagtttttcaatagtatatgtatctgcgtacattctaagagagctgtggtaataccttttgtcagagtaattgatattgtcttgattcttcaaaagcacccagcgatattttctaagcaagataacttcttgtgattcctgaatcgttttattgtctctattggtgtcatgattttgtttttcaagccttttaagatctctatctttatatgctttcattactgaattgatataagtattaatcaatcctaataaatatttaacaacatgaaaactatctaaaatcgacacagcatttggaaagaaatgcttgggtaattcaagataaggcttatatgcatcagaaataatataacgaacatgttttctttcttcgtatggaatggagaagaagtagttttcaatggtatgatgccaccggttatgcaagatgtcaacaatctctccagaagtaaagtccataagaatcaaggcatatttctctttttcagaaatatcaatatgtacttcatcaacggaaagaaactcaggaagagttaaacgtggcaaatccacgtaagcagtgaaaagatcgtgaacttgagtatcagataaattgaattgtctggcaatagatgcggtagaacgatcaaggtctttcatagcctctaaaactagtagaggagtaatatcagaggattgtttataacgctgaaagaatgggaaatcttcattaacatatgtggaacagttagtgcatttccactttctttggctcacgataaagatgatgcaagttccgtcttgtaagacagggtgtttgattttgcgcttataaataccttttgagtgcattctgcaagaacaattagggcaataagacgggatagatggtcgagagatatatacatacttggtatcagcgatgatttcaacatcgttgatgataatagaaccatcatcgggaatgtttaataatttaaatagataagaatgatccatgattacctccttcacagaagcataaccaatagaacattatagaaaaagaaacagatgaatgccacctgtttcttttgggatttatccccctaaagtgtccctcaaagttcagacccctaaattgacccctaaagtttagccccccaaatattttggatacccttgaaaatgaaccggtctgccgaccggtttttctaagcatgtatctgatctcaatcgcttagaatcaaaaagggatttcctgataacgtatttgaaattttccatacaatagaaaacggttttacaggtaatcctttgtattcagccctcttgttcacagaaatgaaaacagaatatgcattgacaacatacacagtgtatgttaaattatagatacacaatgtatgtattaaggagtgatacaatgccgcgcaataagtatccggaggagacggttcagaaaatactggatgtatccatgaagctgtttctggaaaaaggatatgaagaaacaaccattttggatattgtcggagagctgggaggacttacccgcggtgctttctaccaccatttcaaatccaaggaggaagtgctggatgcgctgagtgaccgtatgtttctggagcataatccatttgaggaagttcgtaaggaaaaggggctaagcggtcttgaaaagctgaaaaagattatcaagatgcaggcacagaatcaggatcagcttgatttgaaccagatgtctgtgccgctgctgaagaatccgaagattcttgcggattacatggaaagtaatctgcgaatcgttacaccttttttcgaagagctgtttctggaaggcattcaggacggctccattccggatatcaaatatcccaaggcactggccagcttatttgtaatgataaccagtgtgtggttcattccttccatcgtcccctgtacgcaggaagatctgctggaacgcctgctgctcaccaagcacatgctggacagtatgggaatctacctcattgatgatgaaattcttcagcatgcccagacgattgtccaaagcattccaacaaaataagattgcatatgcaattttattttaccagaatacatacattctgaatgtatataaaaaggagaatataaatatgaacacacaagatctcgctgtttctgtacacaggttaaccaaacgctatggtcatacagaggtattaaagaatgtgaatatggaaatagaaaaaggctctatctattgtctgcttggctccaatggtgccggaaagacaacgacgattaagatactgacaacacttgcggcctttgatagcggtgaagtttccgtatgcggtcattctgtcactgccgagggagaagccgttcgaaagctgatcagtcttaccgggcagtttgccagtgtggatgaaaagctgagcggttatgaaaatctcgtgatgatcggaaagctgaatcatctgaagacgccaaagaaaaaggcaggagagctgcttgcatacttctcccttacagaagccgctaaccgtatggtgagcacctattccggcggtatgcgcagaaagctggacatcgctatgagccttgccggtaatccgcagattatttttcttgatgagccaacaacaggtctggatccacagagccgtcacagtatgtggagcatcataaagcagctgaattcaatgggaatcactatttttcttaccacgcagtatctggaggaagcggagcagctggcggatcatatcgccattctggatcagggaaggatacttacggaaggtactcctgcggaattaaaaaagctgctgccacagggaatcgtcgaatttgaatttcccgacagcagtatgctggagactgccatgtcatgtacagggggctattcgacgaagccggtgatgacagagcataagctgattatatatacggacggcagtgctgaagcattatccgagctgtttcatattttttcttccggtaatatcaaaatcctgaaattttatcaaaagctgccgaatctggaggatgttttcctaacactggttcatgaaagagaggatatacaatgaaaaccatacagacactaaaggatgttttgacgatgagtggaagatgtctgcttctatccaaacgaaatcctgatacaattttaacgagcatcatcgctccgatactcaccatgctgctgtttgcttatgtaattggcggcgccatgcagacgggtgaaacaagctatgtgaatttcattgttccaggaatcattctgcaatgcctcggacagtgtgccgctaccacggcgattgccgtttgttcggatataaaaagcggaatcatggagcgcttctgcaccatgcctgttaaacgctcttccattttaaacggacatgtacgggaagcctttatcagaaatatggtaactgccctgctgattctcctagtggcattcctgattggctttcgaccggaagcggatttacttggttggtgtgccgcattgctgattatttctttgtacattctcaccttatcctggatatccgtatatttcggaatgattgccaacagtccggagggggcaggctcattctcaattctggcgattgctctgccctgcatcagctccggcttcgtaccaatcgacaccatgccgaaagcattgcagatttttgccgaataccagccgattacccctgtcattgattcactgcgtgccctgcttctgaatgagtcattaaagaccggtacactgctttctgcaattttgtggtgtacggtgctgcttctgttattctatattttatccgtaagagcatttaaaaagaaaagcaatcactaacagctgtctcatgcaaagctgaggaaggaatttgtttgctttagcagttcaaaaatttttccgacaggtactggagcaggatgagagcagctatatccgtatgcatcccttaaaaagcttccctcctgcggtatctaagacctgtaaaatctgatcctttcaattcattactgattcagctttacaccacagactatttatcgtaaagtttaactggaaagaaacaaaggaaacagtgtcctgcagagtatactgttcccccgtttgtgaataggaggttgtgtggatatgttaggtatgatcatagatatcatgaaatttctactgctggtttatatcgcattggagctgcgggatatttctgcaaagctaaacaataagtgagacgttctgtctatccagccgaaacaaacacggcaactgtggaaaacccgttccttactacagacattcctgttctctctcaggaagacaactgttttgcactgcttgtaacagggatcgtcatgaacaggctttaaaccggaaatagataattgaattgactgaaaaaaaagaagaaagaaagctcctgtgaaaaggaatttgtttcttctttttgttttttttatgcttgtcttttaatgcgggcaagaagcaggaatacacgattcccttttacaccttgcgctttagcgaaccagcagccttcatacgtatagcagatgccttacagcccgatcatttacagcgatgcaaaacctgcttccactcctcgcacatcccctgtgtgtagaaatccatcagcttctcccaatcctgcgaaagctcttttgttttcatgccatatcgaagtgccgctgccagaacctccagcagctctctgctgtattccccctgctcctgcatcaaagacaacggcttgcggattctttcctcaggcttcagctttctttcaacatcccgaacattgcgcgctacggtatctttgatatttcgattttgaaactttcgaatcgccatttcagaaaacgcggtctgctcctgcatggaaacattatacacagtagtgatacagcgattgattacttccgctatccgtttaattttctcagttatttcaatatcattcgcggcttcggcataatccgtataccccttttcataccccagataggctatgcatgcactgatacagttatacgtatagattttgcgctccagcaaatcggaaaaatgtgtttcctgtacaaagccgtataagggaagctcatgtcccaatgctacgctgtcgtagggaagatggtccagattttcactgaagatatccagtgaatcacgctgtccaagcgttgtgcagaatatgacagcttcactcaaatgtattcgggaatcactgcgcaagacagcaaggggtgaggatggctgtattccattttctgcaacaaggatatccaaagaacgcctatcccgctcctgcaatgccgcctgcaaaaagggcagcaattccgcaacgtgatcggcaccgacactgatgaagatacgttctgcctgtgcgatgtttgttatcgcacgctcatccgttatcgtataggctgtataattatccaccttcagaggctcccgctcacttccaaagcgaatcgtatacgaaggctccttgcgcagctgccggatcaggttctcatcacgatccaaaaaaacggtttcttcctttgacagatacagcagacggtttaaatagccccgcccgcttaatccggcaccgatgattacatttttactcatgtcccttgaccagcccttccttacatatcctatccacagccttcagcacctcccggtacagtggctcctgctcgttcagttcacatacggtctgtaatacatagggtatcccgtgctctcttcgcatcgctttcagcttccttgcggacgcatcactttcctcatcaaagaacagcgcctttgcgatggtttcaattatcactcggggataaaccccatggttcaatgccattcttgccggtgcaatcagccgatcctgtgctcccagcttgcgaagcggatcctttccatgccgtatgacacggtcgacaatcgtccagtctgtatattttgctcttgccttttccgcaaaggccttctgctgctgcggatcgacatgcagctccgccaccagtgtttggttgatttcctcatatacctcatccagcaaggcggaaacctccgggctgtttgcggcctctgccagcagctcatagcctgccagatagccatgataggcgatgacagcgttgcttgtattattggtatacattttctgggttaaaaaatcaccgaagttctgcatcagctccgcatcctgaatcggtggtagctcccccttgaaatgctcggcactgatgggaagataccagtaattctgtacccatacacctgttgcatcctgcattgcaagttcatcactaggctgggtcgcagagcgcatgataactgcctcgttcacaccgacaaactgatcaaacatcgttttctcctgttcctccatctctgccgtaatcccttcatacagaaacgctcccgcatgtctccagttctcgcacgtcacgaagttaaacggctttttcggtatgccgtttaacttatatattcttccgattttctcacccagtgacttcaggtttgcaccacctacggaaacaaaggcgatatccgcttccacaagggcagcaccaatgcgttttccatcctccagctgtaccgcctgaaagcctgtaacatcactatccaatgaagaatctcccagaatatacacatggtatttctgatccttattcaaacgatccaccagctgttgatcgatatccacaaacgtgatatccgccttactgagatacagcagctgcccgataaatccacgggcgattttccccgcaccaaatacaatagccttcatctgttatcctcctcgtataattttctgctttcctgcatacgctgattccctcacttcctgcatagagaacagtcgtagattgttggtatgattctaaaagaacccccgccaatagcagttgtgcggcgggggttgaattaacacgcgtttgcgatatcggtaaatatccttgcccgacgtgtcagctcctcgaaatttccttcagcgataacctttcgatcgataaagcggccgctgatgcctgctgcacagtatccggcgttcagatactccttgaagttctcctcatttacaccggctgccgcaaggaatttcacatgattgatcggccctttgatatccttcagataggacagtcccagccatcctgcagggaatattttcacgatatccgctccggcattgtgtgcctgcaaaatttctgttgaggtcattgctccgggtatagaaatcagaccggcttctttcgttgcacgaatcacctccgtattcacatccggtgacaggcagaattctccccctgcctcctttgtggcaagcacatgctttacacaggttactgtgccgcttcccaccttcatctgtggaaaatgctttttgattgtccttattgcaccgcatgtcttctctaccgcatcggggtctgcctgatcaaaggtaacctccactacacgtataccgccatcatacagcgctctgattgttttgatcagctcattatcatacaagccgcggcagataacgaccaccttgtgctttgcgataaattctacaatttcattcatcctgttacctccggtatacgacctgactgcttctgatacgcatcggtataccgtttcctttctataaatattttgcgatatcctcttccggttctgtaacaatgacacgcaggaacacgttgattcccttgtttaacagattgcggaaggcttccttttcctcttcactgacagatatgtttttgaacatcggctttcttccggccttcgcgccgattcctccgacattgatgctcttcagacggacaccggcatcgctcagctcatccaacaccaccggtgtctttacaagaatgatgattttctcatgctttccatcttcattcaagtatccgattgcatccttgacacttaacacctttaaactgattttgccgggaacactggatttcataaccatctgcagaaaggaatcctttgcgacgccatcatcgatgatcagtacctcattcgcctcggtatactgaatccattgtgtcatgacctgaccgtgaatcagacggtcatcaattcttgtccaaacgatatgtttcatataaggtttctcctatcattttgttactccaaaatactccatcagatgctcaacggcggcatgtgacatggtattgactgcctccacactgacggcggctgtatgcgggctgcataccacattgttcaaaccgataaattccggattcatatgtggttccccatcaaagacatccgttccgtacccatagatacgtttttgccgcaatgcctgaaccatggccgtttcatcgatgagagaagctcttgcggtattgatgaggacagcctcgggcttcatcagctccagctcctgctgagtgatgaaatgtgttccatccgcgttgccgggaacatgcagtgtaatgatgtccgcctgtttgaaaatctcctgtggggaaagcagacagattccctctttttcgcagtattcttcatctgcgaatatatcataccctaatatcttacattcaaatcccttgagacgttttacaacctgacggccgattgcgcccagaccgaatactccgactgtcttatggcataaatccataccggtttcctttttccatatccccttttgcaaggaggaatgcacattgcatacatggcgcagggtcaccagcatgagggcaatcgtataatctgccaccgcctccgtattacagtttttcgtcaccgtgacagcaatgcctcttttttcagcctccgcggtatcaatgttgtcaattcccacaccgtatctggatataattttcagtttgtcagccttatccagcacccgtttactgacaatatcagagccaagtataatcgcatccacgccgggaacctcgttcatcatttcttcctcgctcataatatgatgatagcggttatcaagcagctcccagcctagatccagcatccgcttccgcggtgcctcatcaaattttccaaagctgttggatgtaatcagaaccttcatatactgcacctgcctaaacgattcccagcagtccaccgatgattccgatggcaaacagaatgagcagaaccttgtttacactaacttttttattcatcagataaaacgtcagcatgaccatgccaaagggaagcagattgtttacaaccttatccagaatatcggtctgtaccgccagcttgttgtcacccagagcaatctctgcagttgaagtcagctttacagtcgtggcggcaagtgcaccgatggtgatggagcccatagcggttaccattgtcatgattttctccatcttcccgccgctgaagaattcaccgacgaaatcgcgccccttgtcatatgccttgcggtacagcgtatagctgataccgaagttcagtgccagcgtcacaaagaaatagaagatcggtcccagaagatttccttcctgcccgatggagattgcgatggagccgatgatcggaatcagtgttccctgccgcagggtatctccgattcccgcaagcggtcccatcagagaagtcttgaccgcactgatcgcaagtccgtcgatttccgcaccacaggccttttcttcctccatggcaatcgtaagaccaagaattaccggccctaccagcgcaaattccgaattataaaattccatatgacgctgacatgcttctgcacgttcctcagggtctgtgtataatttcgcgataacattcttcataccggagaaaaatccgggtgcctgcaatcgttcatagctgcagcaggcctgtgcaaacacctcaaacatgaaataggatgtattcagatcctttattgtcagctttctttccgtcacctgttcactcattcctcattccctgcctttccgaatttcaattcaccatagaagtaagcagcgattgccgcaaaaatcgataccaccagcatactcagtccggagtatgtttccaggaagaatcccagtgtaaagaaaatcaggattccgtttcttgtattcagcatacggatgatcatggcaataccgatggcaggaagaatcccgccgatcacactcagaatatgaagcggctttcctgccagcatgtccagcagtccctgtgtagccggagcaccgaagtaaaccagcagcgcacatggaatcatggttactgcatatccgaacagctgcgtcggtaccagctgccagaatgccatttttttaatatccccggtaactgcatatttgtccatctggtgcacaaaatagatgtttacagtttgacgaagcgtccataccatcgttcccataactccaagcggaaccgcaatcgacatagcgacctgcggtgtggcattggcgctcagagcaagggctgtccccacaacaccgccgattccgggatccgttggcagcgtacctcccgcatttacaaagcccagatacagggtattgatcgtagcccccatgatacagccttccaccggctttccaaggatcaatccgacaatcgttcccgcacagatcggctggcgtatggaaacactgcccagcccggtcagccagggaaccccgttgtttgttaaatagtaaagcgtaccaatcagaatggcctgaataattgaaatctgcataacttatctcctttcagcaatctgcttataactgaaactgatttctcagatccagaatactgttcccaccaacttctaatgcgtgctgcttcagctcctccagcttcataaaggtcttgctcgtagccacctccagaagaatcggaagattcaccccggtgatacactcacagtgaacgctatcctgcagctcgtgcatcgcccttgctgccgcattggacggactacctccgaataaatccgtcagaatcagaacaccgtctccctgtgagcactcagacaatctgattatcgcctccttaatcgtgtccttcagattatcaacactgtctccgtgatataaaccatgactttcaatcagcgctgcttctcccataatcagtgccgcacttgacaacagcgcctgtgccagatcgccatgtgtcaccaataacactgcaaccatatttctacctcctcatttcaccagctgccggttgttcgacagtcgttctcaacttcgagtgtattgtatcacgctgttttcgccacacaaaatcgttgctttttttacacagtaaacaaattgtgtaaagcgatatttcatgtatatatcagcggtttctttttatttttacagaaaaagtaaccgcttttcttcctatccatacatatgtgcgtaagtttttgcacaatcatgatgaattaaaaatacattctgaacagcagtgtgtaagcgactcgcccattttacaccaaataccggatatttttgttataatgtcaaaaaggaggttaggctatatggacaagaaaaaagaagaggtgtatcagcatctcatccgtcatacagcaaagcagctgcagcagcgcggaagtctgggaagggatgctttgaatatcagtcttgatctgcaaatggaccgctccaatgtatcgagacttttaaaccagctgcatcatgagggaagactgattaagacgcagggacgtccgactctgttttttgccagaacaccattggaaaatgagcatccggatgtacatatccccagtgtcattccaaaggggaagagtattcaaagctacctgaaggaggagcatgagctaaaaaacgaacagacacaggcggatgttttccgtcagtatctcgcaaaccgcgataccagcagtatgtttaagccgattcaacgggcgaaatccgctttgctgtatccgccgcaggggttgaatattctgttatacggggatccctgtgtcggaaagcttaactttgcgaaaacgatgtttgaattttgcctgcaaaggaaaatctttactcatggatcacggatcgttgtctttgactgtctgaattatgccgatcaggagccggaggaaatactcagtaagctgtatggctattatgatggcagccatttgaaaaaggggctgctggaagcaagcagaaacggtatgctcattctgaatcacatggatcgtctttccttttccgccctgaccagtctgtacaacagtatgatcagccaatcctatacgccgctgcatcttccttccaaggaatatccgattcgctccctgatagtgggtatctccaacacggaaaacatgatactgaatccggacatacgccgctgcttccctatgcagatacatatcccctgtctgcgggagaaatccattcaggaaatgcttgttctgacgatgcagtatttccagcaggaggctgcacatatcaataaaaccatacggatatcaaagggcgcactgagctgttttgttatgtcggactattccgggaacctgcctcatctgcatgcggaaatcaagcaggcctgtgcacacgcctttcgcagctatctggagcaggaggctctgtttgtcagtattgattatgatgatatttccacacaggtattaacggatatttatgacgtgaatgaacgcatgagtgaactggataacattctgaatctgtttgccggtgagtatctgtttttctcatcgctgaaacagaatcaggagctggagctgctgtatgatctcaatgacggcaccagcaaaaaggacagctatctggacagcattgatgataagctgatcaatctgtgtatacaggatatcaatgcggcgatcggtatccacctgaatacgattcgctccgtaatgctgaagcaggtttatgatcttttgtatccgattctgcaaaacaatccgatttgtaagaatgaaaatctgctgtacggtttacttctgcatgtatccaattccatcagctgcatacgcagtggtaatcaggagcttggctttcgccgggcagagtaccgtatcgccaagcaggaggattatgactgtgcgcaaagcattgtttcacacattcacacgcatcaggagctgcagcttcctgccgaggaaacggattatatcgccacctatctgtatctttcctcacaatggatcgacagcaattatattcagctgctgattatcagtgtggataacgatacagcaaaggagtatgccgattatttgaacagcctgtccttcaaaactgaaattcactaccttcgtctgcattcacagatctcccatgaaaagaattgcaggctgattgccgatacgatgcattccatcaatcgcgggaagggtgttgtgattgccacagacagcagtacagtcacagcaagtgaagccatgctgaaaaaactgagtgatgctgcgtttaccattgtaagtgatatatcggtaaaaacactgatggcgattgtggaaaagatggaatcactcggttccaccttaagttccatccagtatttccgacaggaaaacacaagggatgcggcaagtgtaagcgaaacggaaacacatgcacaggagctgctgaatgatatcacaaacaaggtactgtctgagtcactggtatttctgaatccgcataaggtctgtcagtctctgtttaatgtattgatcaatattctgcatgatttgaatatttcctatacggatgatttgttgattaagttcatattccacagtggatttatgatcgagcgatgcatacgaaaagagcccctgtcctatccaaaggccagaggcatcatcaatcagtatgatcagatgtattatatcatggagaaaaattttgaaattatctctgaaattttcaacgtgacgattccttcttccgaaatggcgatgattatggagatattcctgccatatatgtaggatgtgttcgcttactttctagcgttccgtcatgaaagcaaacaaggtcaaacgaaaggtgaacctaaaagcagcgggaagaagcacgatgtaggggttgcagctcactgctgctttatcctaaggacgtatgtgatgtgatgaaatgcaggaacataaggatgcctccttttcgaaaggctatacaaatgaatccccttataggtcttcatttccatcaacagcttttctgatatcgccaaacactcgttcgagcgaatatcgttcctcacttgtttccgcaatacgatcagcctcatccagcttggtctctacaacatctgtaagacttgcataccgttccagactcataaccaccattgtaccatagccgttctttgtaaggtaaacgggttccccaccatttacaatctcttcaatttcagagaatttatttctcaaatcagaaacaggacgaatttgtatcatatcaatctactcctctccattttgttatcataactttatcacaataacaatataaaaagttatttctgtatggtatcatccaccagcgtaacgcagttcggatgcagccataatagagatgccggagtagaggttgctattctctgactcataaatgcctgataggctgcttcctttcgatccccgcaaaccagcataataatctgccctgatgtaaagattccctgcagtcctatcgtcaaacctccctttggctcatagccctttaccatatcgtgtgtttttgttttctcatccagctctgcataatgtgcgttcagtgtaaggaaatctgaaggctcattcaatccgagatgtccattcattcccagtccgagaatcatgacatcaataggatgctcagataaaaacacatccatcctatccagctcctgcctgatatctgccgcatcggacacaaattcaacgaccgcctttggctgcatatacagctgatccagcagatgctccctgataaaggtggtacacgtacaggctgcctgcggctctactccataccattcatccagcttcacgaatgtgatttcggacaggtcgattcgttccctgttcaccgcttcacataccagctcatacatccgcgccggagagcttccggtcgcaaggcagataactgcatccggcttcttacgcagtgtatccatcagcaaatccgcagcctcttttgacattgcttcataattctctgtatgtatcagtttcataattacctcctatttttgaaaaaagctatccgaaattcttatgtggatagctttattttatcatattttaaacaagtccgatccatgcgcccagaatggaaagcacgataatggatacaatcaaaacgattggattcgcctgtttctttttcagcagccagaacagcagcagggtaacacacattggcaaaaagttcgggaagattcgatcgaagaactcagcctgtaccgcaacctcgataccaccgtctaccttaatgacaggcagcaggttaatcgtaacataggaagcaatcagcgcaccgattaccgtgatacccagaattgttgcggaattggcaatcatatcagagttctctgtgatgatatcaatggaacgtgttccaagggtgtagccaagacgggtccagacgatacgcagaatccagataaccacataggtcgcaaagaaaataatcggtcccagaacggatccctgtgatgcaaaggaacaggagatacctgcgacaatcggcagaatggtgaaccagaagattgcatcaccgataccggcaatcggtccaaacagggccagcttcagacccttgatagcatcacgggttcctccaccttcctccaaggacatcatcaagcccatcagaaagccgactaggtttggatgtgtattgataaattccagattatctgtcattgcggcagacagcttttccttgtcatctccgtataccttttccagagcaggcagcattgcccatgtaaagccacaggcctgcatacgttcatagttgaaggatgcctgcaggaaggaagaacgtataccaagcattgtaatatcatgttttgttaattttttagatgccgacattcgtgtcacctccagttatccctgcgtttttcacagcttcttcgatttcgtcttttctctgcttcacaccgaagaagtcaatcagtgcaaatacggtaccaagcagcgctaccggcagcaggttcggcatttcacagaagcatgccatcaggaagcctgcaataaagtaaggtgtgtattttaccttcatcataacacgcagaagcatagcaaatccgactgccggaagaataccgccggcaacctcaagtccgtgtgtgataacggcaggcagtgcgtttacaaagtcagccatcggctgctgtgcaacataggtacacaggaatgccagtgctccataggtcagtgagataatggtcatggttgtgaagttgatgcggcggattccctttacatcagcctctgcagcacacttgtcggcttttcccataaagaatgagaaagcggaataatagaacagaatgacatactgtcccaggaaagagaatggcagacaaagacccagagcagcttttggatcacagccggttgtatacgccagtactgtccccatcagacctgcgaatacagggtttggcggctgcgtaccaccggccggtgtcagccctgcgaatgcaagctcaatcaatgcaccaaccttcagccccaaggtaatatcacccaaaatcagtcccgtcagtgtcgatacgatcagcggacggaagataaagaacgcttcgaggaagaaatcaagaccgacgataatcgtcataatggtcagtaggattccctgtaaaagtgtaatctccatattactttcatctccttttcagtttttgttattcaatagcggatttcggatctcccggtacatcctgtgcatacacattgatgccctttgataccagatacttcaaatcatccatgtcttcatcatcgacatagaccttcttagtcatagcgcgtttcccttcggagaaatgcatgtttcccacatttacctccttcagagcaacaccggcctccaccagacggcggacatccttcggcgtacggcatacgataaagattttctgttccggtgctgccctgccaatgatggcagccgttttttcaatcgtaaagaaacggattcccacaccggatgattttgctgtgacactcatcagtgactgctggattctgtcctctgcagcagtgtcgtctgccacaacaatcagattggctcccagcgtctttgtccatgtgaccccaacttgtccatgtaccagacggttgtcaattcttgttaatagaatattcggcatatattccacctccattcacttttataatcagcaagaaacgtgccaactttctgtcgcagcacgtttcgcttgatttatttagggtttttgaagtaattcaatacataaagtgcttccggcgccggaagttcgacactatatctcgtttccacgccactaaaggcatccttgaccttgtcaacacgatcctttttaccttctactgccttttccataccctccacatgctcaattccctgtttcaggatcaggcgttcgatcagacagctgatatgtacatacagaccaaccttgcgggtggcatccagctcctcgttcagatcctcctccagattttccacaatttcctccacatcgtcgataattttttctccgttcagaatagtcagatgattcacgatattggacagggtgaaattctttgtgatattctgattgaacgcctccagatcgacagctcccagataccgctgcatcagctgttccagaacgccgatttcatcgttcatcataacactttcaatcgccataaacggaatgccgctcaccttgggatccagcgttccgacaatcagctccacctgataccggttgaagatggaatcacggttcccgttttccaccagctgctgataattataagggatgatttccagatcgattttgcgtggcagggagccctccagcagctcactgatttttttcgctgccccaaagccggtggcacagatggaaaggatggcagatttcttttttctgcttttcagatagtgtgtggaaagctgatggttctccttcaccagctgcaaaatttcctccactcgttttccctgcatgatgtagttgccgacctccaatgccatagcggtagatacattgttgatcagcgcaatattataatcggacatcggcttgattcttgtatagatttcctccagactacccatatccaccagaaaaatcagttcgtgtatggttcccttgcgcttcagataatcatctgccagctgcgccaccttatcgatggtgatattgatttccatgtcgataccgtcaaacacatactgccccagcatacggttcgctgtatccgcaatactgcttgcggtggagtagccatggcatagaataacaccgacacaggagctgacctcttcattctgatagcccgcaaatgcgatggcgatgatcaccagcagcagctcatcaagctccaaatccagattcagacgcacattctccacaatttcctctgctatatggaagattctcggcattcgctcctgaacctcctccaccagcgcttttaccgttttctgatgcgcactgatccaaacattggcatcggttgcacattttgaatattcaacaagaatgcgggaatagattttgatttcattattcggtatgttgatggagtatttattcatgacaatggaatagattttatccagcagcttcaacaggtatgcctcactcgtatttttctgatagcggttatgaaacatgacataatcaatatagctttgtatgagaattccggttttttccatatacgcaggaaaggcatttgtcgaggtttgatatccctcatactgcgtgaccagctgactgtacagatgcagcagcggggacgcctgattcagcgagcccttgagccgctcgattggtatcatagcctcctgcatgccatgggtggaggatttcagctgcacggaggtcagggatggaaagatataatccggcaaatcagccacctgtattttcagcttcggctctccctgatggacgaggaaggaatttgcacaggctgccttgatggcatttttcaatgccccgacattgccgataaactcaaaatccatcagactctgataggcgagattgctgatgaggatttctttaccaaggcgtttgctctcctttgtgaaaatcgtgtagatcagctcccgcttttcaatcagcggacgatccttcaatgccggaacagtaatcgttattggaattcttcgcagcagggtctttaacagaacattctgcgggtcctccgttgttgcgaaaaccagtcggcatttggaataataccagttttcattatccccgaccttgtgatacatacccttgtccataaagaaaaacagcttttcctgacattccgccttcaaacagtgcacctcatccagaaacagcaatccgccgtctgccagtgaaatcagcccggggttatcctcatccgctccggtataggctccctttacatttccgaacagattggttgtcagcagctctggattatttgcatactccgagcagtttaccgccacaaatttcttgttctttccaataatattctgattcaccgcatattcatacatcatggaggcaatcatgcttttccccgtaccggtcggtccgttgatcagaatcggcagtcctccgggataggatactgccgccttgcaatgctccaccacactggatagagaattgttacagccgatcagctgttcaaaatcctgtgcatctcccaccagctcctgcgcaagctgttcaaatgaatcaaaggtgcatttggtcacaacaccgctccatttgttttccacagcctcacgtacaaaaaagtataccgggcgggaattgattttgattacatcccctgtctttaccctttcattcaaatactgggataccgtattgcgactgatatgcagtgcatcagcaatactgactgctgtaaatcgcgtgtgctcctctatggcatattcctcacagcgttttttcaattcttcaaatacgatttccttcattgcgttgttcctgcctttccattctcaacatgcatgtatacaaaagcgaagaccatttaccttctccgcttcattgtctcgtaatcaagctcactgaatttctcaacagccgatccgggaacatcctgatagaacacctctgtcccctgtgaaatcatatagtttatgtcctcaatatccggctgtgtaagatatacctttcggttaaatgcgactctccccttttcataatgcatattgccgacattgacacgcttcaattcaattcccgcttccaccagcagacgcgcctcatgcggtgactgtacgacaacaaacagcttttgatgacttgtgttgtcattgtatgcacggataaagtcatgtactgtataaaagcggatctgacggcttgcggcagaggcaacactctgcatcagcttctgtgcaaagctgctggcggcagtcaggttatccacaacaacaattgtgtcaatatttaaggtacttccccatgtaagaccaacctgtccatggacaagccggttgtcaattctagtcaattcaattcttgctctcatatgaaccacctcatttctttcattttaacccatttttcaaagaaatgatatcctaaaaaaaattataatacaagcacaggtacatgctgtaaatccataacagctacgaaagactgccttttcatcagattcggaatatgccccctgcttacaaaatcgaatatgcgcatagtataaccgttttaccatatcagaaagaggaattcaccttccagaatgataatatctatatcggaatgccctgtgatctgaatcatgaactgaacagtatgtaaatttttctatgctgatatcgaaaagctgtacaggctcgctaccactcgcaagctaaaaaaagacatactgttttacacaatatgcctttctgtttccttatggatgcagctgaccgtacagctgacaataagtttccgcactctttgcccagctgacatctgtattcatcgcattgcggacaagaatcttccagtcctccttacgattataatagacatcaatggcattgtacatcacctgaagcatttcatcagagttgtaattcgcgaagctgaagccgttacctgttttctcaaattcgttatacggtgttaccgtatccttcagacctccggtttcacgtaccagcggcagtgtaccgtagcgcatggatatcagctgtgagattccacacggttcaaacagagatggcatcaggaacagatcacatgcaccatagatgcggtgtgccagagaatcattgtatcccttgtagaatgcaattttccctttgtttcctgcttccagctgcgccatcttttcctcaatgcttgcctctccgcttcctaaaacagcaagctgaatcggcatagcacagatttcagagagcttttccatcatcagatagaagcccttctgccaggtaagacgggaaacaacaccgatcagcagtacattctgatccacattcagaccgagctccttctgcagtgcttccttattcaagcctttggctttctttacattcaccttgttgtagtgatatggaatttccggatcattcttcggatcccagtattcaatatcaataccgtttgtgattccccacaggtcatatttacggatattcagcaccatttccagatgctcgccgtactgcggcgtcagaatctcctgagaatatgtaggggaaactgttgtcaccttgtccgcatacagaataccggacttcatgaaactgattccaccgtcgtagcgtacatttccgttgtcataaattcgataatccagtcccagacagctgtccagcatttccacaccgaagttcccctgataagccagattgtgaatcgtataaacaaagcggatattgcgatagcgttcatcaaagctgtgaccttccttgcacatagcaggaatcatcccggtatgccagtcatgacagtgcatgatttccgggaagtagttcagctgattgcacatttcaatgacagccttctggaaataagcaaagcgttccccgtcatcaatatgtccatacatttcttcacgctcaaagtatcccttgtgctcaacaaaatagaattttacatccttgcgcatggttgaccagatatttaccggtacctcatgatacgcaatactcacggaaaactgagcctccagcgtaaattcatggtgaaatttctgagcaattttcaggtacagcggcatgataacacgcacctcatgaccctttttagccagctcattcggcagggagccgattacatctgccagtcctccgcttttaataaagggaagaccctcggcagcaaccatcaatattcttgccattaaattttatcattccttttcacgtacagcggagtgtcggcaaggcccagcagttcttttttacggacgattcttgctttcttatccactactacattttcaatatgcacatcttcaccgatcatggcacccggaaggatcacacagtttttcacaactgcccccttcttgataatcgccccacgtccgatgacgctgttttcaatatcaccctctaccagacatccgttggaaaccatactgtttttcacactgacacctgcgtagtactgtgtaggacaggaatcgttggttcttgtataaaccggccagtctgtatggaacagatccatcgccttatcatagtccagcagatccatattggcattgtagtagctcttgaagtcattgatacatgccacaaagccacggtgtgcaacaccacggatatccagctccgcacactcatcgtttacgatatcgtggaaccagtacagagaagagatattcgccgctttcttaaccagatccataaacagctccttgctcaggatataggtttccagagaaatcgttctggatttggagtttccgcgattcttctccagagacagaacacccttctgcttgttcagattcacaacatcacagtttacgaaggattcctttgcattatccacattctgatacagcatggtgatatccgcaccgctttcgatatgcgtatccagcagcgcactgaagtcctgacggaaaacaaagtgactcggtgtcagaacaacgtaaggataattggcatcctcgattgcctgcatgttgtacatataagaattgatatcattgctgtagaaatcattttcatccatgctttttgccggcaggatgtgcagctttccacgcttggagttaatgttgtaatgacgtccggttcccagatgctccaacagagatctcggatttgtttttacaaacaccttgatatgatttacaccggaattactcagattagaaattggaaagtcgaccagacgatatcttcccaggaatgagaaggcggataccgggcgataatcctgcatacctttgacctgtacattaggtccttcataattaacaataccgattgcattgcacatattactcacccctcactctcttgctgatcagttcgatttcttcactgttcggatcacctacgacagcaccggcatcaatcttgacaccctgcatgacgatggcacggtgaatgacggcaccctcgccgacctccacatccggtaacagtaccgaatcgttgaccttcgcattctttgaaacctccacgttcgtgaacaggactgagttgttgatttcaccatcgatgacacatccctggttgatgtatgcattatccaccttaccattcggtccgatataatgcggaacagttgctacatcctctgtatagattttccagtttggatcattcagatccagctcgttgtttttgctcagcaggtccatgtttgcttcccacagggaatccacggttcctacatccttccagtaacccttgaatttccatgcatacagacgcttgttctccgcaagcatggcaggaatgatatcctttccgaagtcatggttgctgttaggatcatccatatctgcgaccagcatttttcgcagctgcttccagttaaagatatagatacccatggaagccagattgctcttcggatgctccggcttttcctcgaattccacgatacggtctgtttcatccgtgttcataataccgaagcggcttgcttccttcatcggtaccggtaatacggcgatcgttgcatcggcatcgcatgccttgtggtgggaaagcatcttggaataatccatcttgtaaatatgatctcccgacagaatcagaacatactccggattgtggctgtcgatgaaatcgatattttgtgagattgcatctgcagttccgcggtatacgtcaaacgctgctccgtctttctcacgaggcggcagtacgtatacaccactgtcttttgcatccagtccccagcgctgtccagctgctgcataggaattcagcaatacactctcatactgtgtcagtaccccgacaacgttgatgttggagttggcacagttgctcagcgggaagtcgataattcgatatttccctccgtaatacactgcaggttttgcaatcttcttggtcaaggcatacagtcgtgttcctcggcctccggctagtatcatagccagcatgttgttttgtctcatgtaaatccccccttaggaattttttctatatattaagtataatgattttcaacataaatttccaccctttttgtaagaaaaatgaactttatgtatgcgttttcagcttttcgggcataaatgacgccaaaagcaaaaacacgcggaaaagtcaagtcaaaatttcattgatttttttctggttttcatgaaatttatgctcaatcttatactcgcatgttcattatattatcgtatgcggcagattattccaagaaaaacaatctgccaaatacttcctttttcagacaaagtcgtacatgttgagaaggtcatcgaccgttgtgttctttctttcttccccttccagcaccttgacgattttcccttcattcagaataatcgtcttgttgccgtattccagtgcctgcttcatgttgtgcgtaatcatgagcgtagtgatatggttctcctttacaattctctctgtgatatccatgacagaggcggccgttttcggatcgagcgccgccgtatgttcatccagcagaagaagcttcggtgtgacgatggtagacatcagcagtgtcagagcctgccgctgtcctccactcagcaatcccacggttgtggaaatgcgatcctccagaccaagtcccagctccttcagcttttcgataaagaagcttcgatcacctttttttattgcccggctcagcgttgtccgtttaccacgactgtaagccagccccagattctcctcaatggtcatatgcggcgccgttccttttaagggatcctgaaacaggcgtccgatttctcttgcccgcttatattcgggatagactgtaatatcctttccatccagcaggatcgttccggaatcactcataatggaaccgctgattacattcagcagcgtgctctttccggcaccgttggtacccagcacactgataaagtcaccattctccacatggaaggacagatgatccagagcctttcgctcattgacggtattggcgtgaaaggttacgctgatatcctttaaatcaagcatgcgatcccctccttctctttttcagatgcggcagtgatattgccagtgccacaagcgctgcggagaacaggttcaaatcacttgccccgattcccagctgcagtgctacggtcagaataaaccgatagacgattgcgcccacaacgacagccgcaaattgaaagcccagtgtttttctgcggataaatgcctcacccacaatgatgcttgccaaaccgacaaccatcataccgattcctccgctcacatccgcaaagccctgattctgtgcgaagactgcaccacccagcgccaccagggcattggcaagtgcgatacccatgattttcatcaaatccgagttgatgctgctggcacgcaccatcgcttcattgtcaccggttgcccgaagactcattcccagctgtgttttcaaaaacagatacagcagaaggatcagaaggatgagaagcccggcaatcattacaccataggcatgatcaccaagcactgcctccagcggtgtaaagatggttttctttccgaacagggatacattcggcatgccgttcagtattttcaggttgacggaatacagggctgtcattgtcagtataccggcaagcagggactgcaccttgcatttggtctgcagcagaccggttaccagccccgcaagacctccggcaaggaacgccatgagtgtaccgataaacgggtgagcattcattgcgaatacggcagataccgcacatccggttgtaaagctcccgtcaatcgtcagatcgggaatattcaaaacgcggaaggaaataaacacccccagcgacatgatggaaaatatcatgccgagtatcaccgcatcctgtatggttgataatgccataaccctcatcctctcttctactatactgttacctgtaccgcttacttcttacatcagccctatgctccttacagattttttcatacggctgtatggctgtatgatacagattccattacgaaccatgtattactttcttaatctgtttagattccgtcctgttttttcaatacgaaatctgtacccagcacgattatcttccttttatatatcttttatatccttatatatgacaggcctgttcctattgtgcacaggcttacatcatgaccagatttttgctgttttctacatcctttggaagctgaatgcccagtgtctccatcgttttctcatttacatagatattcagattatccttgaagaccttaaccggcagattctccacatcctcgcccttcagaattttatccgtcattcttgccgtttccttgccaagctctgtgtaatcaataccaaccgtcgcaaagccgccgtcacttaccatggaatcagcacctgtatataccggaaccttcttcttgtttgcagtttccacaagagcactcatagagcttgccaccgtgttatcgtttggtgcaaagatcgcatcacatttatcggtaagcacactgactgcgctctgaatctccgtgatgtttgcgccgcttccctccaccagcttgatatcgtgttttttacagaattcctttgcctttgccagattgcttacggaattcgcttcggagctgttgtaaataaagcccagtgtcttcagattagggtctaccttcaatgcaagatcgagtatctgatccacctgaatttcatcgcttgtccctgtgatgttgttgttcggttttttcagatcatccatcagacctgcccctaccggatcactgactgcggagaatacgatcggaatatccttgctgtacttcgctgccgccatagctgtcggtgttgcaattgccacgatgacatcactcttgtttccggcaaatgtcgacatgatggaattcagcgtgttctgctgcccgccggcatccttgaagtccagcttgatattttctccatccttatagcccagtgcctccatctctgccttgaagctgccacgaatcgtattcagtgacttatgctctacaatctgcgctaccgataccaccggtatttttttctcagttttcgtatcctccttgcttccacatcctgttaatacgcctgcacatagtagaaatgcagctgctgccttacataattttttcatgacctgttgtcctctctttcattgtgttgttttgtttccttcgtttatatgacgtctgtttacccttatgccatcgccattcctctgtgctctgtaacacaatgaccacctcccttatataaaaaagcacccgtccaaaagtctgttgacttcaggacagatgctgttagggtcatctgcggtaccacctgatttgatcgttccatctattggaaaccatcctctcatcaaaatgccgacacatttctagccctgtaacgtaggcatacgtcttggatactgagctgcgccgttcaccttgccctccagagtccatttacaaaactgcatttctgccgcgattccaccatccgcgtgctctctataagcgcatctttctgcttgatctctctgtctttggtttcctataggatacacctcttctttttgcttgtcaacactttttctgaaattttacattttttattctgaaaatattttcaccatttacaggaacagcgtctgtctgcttacagctgcatcgtctctgtgtaatcaggtgaatgtgcttccctatgtaatgtctgcattcacagaagcctactgcctggcgggcgggcaaatggtgatgcgttggagataatagagccatatctgttttgcctagccgtgttctccctgcgagtttccatacagatgaaatccgctccatagctgcaggatggcagttacagcagtgatacaaaagacagcaccagattgctgcatatatgcttccttgcaggaaatcgctgtcaggataccacagataaaagcaagcacagcggtcagcccgagctgcttccagccgatttccatatactgcagaccgtgaattctcgtatcataatacatattttgtataagctgcaaaatgaaaacaagcagaagggcaatcagccacagattggttgtacccggtagccagggaaacagaagaaagccggtagcgcccagcatgcactggattactcccagcaatagggagggctttcggatatatacatatggacacatttcgtttgtatattccatttctgcctcctcatggtgcatacgttttcgtagtaccgtgcgctgactttgcaggcgcaccatctgcatatcaagctcatgaatcagctgttcatagacctgaggtgcatattcttcctctataaggattgcacgtatttcctttatatgcagtcccatctgccgcatggcatgaatatctcgcaatgttttcaggcagtcttcatcataatcgcggtagccgttttccagctttaccggctttacaaagccctgatcctcataatactgtacagccttcctgctaagaccgcttttctccataacttctttcaacagcatttctctgtcctttctggctttccaagttgccttcccttttgaatcacaggcagccctttttttacctgcaagtcatactatgaaagcataaccgtacaatacatcccttcctgtttttttacgtaactctttctctgatattctatagcagtgttgtttgcaggacaagctcttttgcagtattcatgtaaaaatcaggagagttcctattttttttatgagactgcgatcgttcttttactgtatgatgaagcaaagcagctttttctccctattcgctttataaagcatgaaaaaggatgcactcctcacgtattccaagcaaagcattgcatccacggtatccgcatttgcaggcagctgcaccgtttggtattcaataagggaacacgagtagaaaggccataccatccgcttccttttcggcgaaaatttccgcattcatacgccgcatgatttcccggcatatgtaaagtccaagaccgttgccctgcttcccctcgctgttgctggcacgaaagaagctttcaaatatatgatgaaattcggtgtcactcactgtatttccagtgttaaaaatacgaatcagctgacaatagtcctcttcatagcacgatatttctatccttcttccatctccgtatttcaaggcattttccataatgttttccacgacctcaaagctgcgctccaggtctcccttcagcagcaggttttcatagggctttaccaccagctccatacgccgcagtcgcaatggctctttatacgcgtgaacagccttgtcgatcagctccttcaaatagaattcactgttttggacctgtatatccagtatgtcgtgacgggactgcttcatgatttcttcgacataatgttcaatttccttccccttttcctgtatctgatgagctgcgtgtacattttgtgcctcatccgtatacagatgctcctccaaagcccgcgcgtacagctggatggtgttcagcggtgtcttaatatcatgtgacagagaaagcagcagcttcttcttttccttttccagctccagctgccgccttctggaagtatccagcgaatccttcagctgtccgattccaagcaggaaatcatgtgcatatctgcttttttcctccttcacgatccccttccaatgtcccttcgcaagctcaccgggaagcttacgcactcgatcaaagggctttaacaggtgctttctcagatagagaagaacacccagcagcattgcgaacaaagcggcgagagacagctgtgtgcgcagcatcagtccgttggtatccacaagcgagcgatgataatcaaagcgcagatatcctgtcagcttttgctttctgtagacgggtgccacatgcatctccagattatttccctcctggaaaaaggcagaggctgtttctctgcttccttcctctgcggacagccattgcagcttttcgatatgcggatagctgttctgtgcgatatcctcagccttcgtacccttttccacctgctgcaggatacgattgatttccacacgatatgcatggtccatggtttcctccatctgcagaatactccacccgagaaaggctgcaatgcccagatacagcaggaaacaggaaaggatcaggatattatacttcttcaaagcgataccccacgccccagactgttttaatccgctgcggctgttttggattcttctctattttgtcccgcagcattttgatatgaacggtcagtgtctgctgttcactgaagctgtccatgccccatatgcttgcgaaaatatattccttgcgcaaggtcttcccagcgttggataccagcagtgtcaacagctcgaattccttcgcattcagctccataagatttccatccacaaaggctctgtgctgtgcacgctcaatgaccacaccgcagcaggatatggtttccttgcgatgcaaatcggatgtacgctgtaaaacagcacgtattttggcggcaagtatttgcggatccacaggcttttcgatataatcatccgcccccagctcatagccgttcagctgatcatttcgatcctttcgcgcactcattatcagtatcggaaccgctttatgctcccgcacttttttgcataccgtaaagccatccatatggggcagcatgatatcaagcagcagcagacgtacctctgtctgtgcaagataggaaagcgcagcctccccgctctccacatgatgcacctgaaatccatcccgctttaaaaagcttacgatcagctgggcaagctcacggtgatcctctacaagtaatatatctatcataggcaattaccatcctaacgttatcagccattcatttaatctgcgctcccgcttgcggatatccgtacagtcttcccatgcgccaagctgcatttcgtcccggatatttccgtcctcgatatacagcacacggtcacggcgtgaggctaccttcatgtcgtgggttaccagcagtatgcttgtcccttccttatgaatacggttcagctcctccattacctcatgagagctctgcttattcagggcacctgtcggctcatccgcaaacagaatacgcggatgattgatcaggctgcggcagatacaggcacgctgcagctgtcctccggatacctcattcacatcgttatccgcgatttcactgatgccaagcttctgcataagctttgcggcataggcattgatttcttttcttccctttacagactgaaaagtaaaccacagagtaaaccacagaataaatcacagagtaaagtatgctgagatgtatactttttctttcataaaaagcttttataaccgctgccaattccttttaattgcgtattatctcagcagacgtacctctgtctgtgcaagataggaaagcgcagcctccccgccctccacatgatgcacctgaaatccatcccgctttaaaaagcttacgatcagctgggcaagctcacggtgatcctctacaagtaatatatctatcataggcaattaccatcctaacgttatcagccattcatttaatctgcgctcccgcttgcggatatccgtgcagtcttcccatgcgccaagctgcatttcatcccggatatttccgtcctcgatatacagcacacggtcacagcgtgaggctaccttcatgtcgtgggttaccagcagtatgcttgtcccttccttatgaatacggttcagctcctccatcacctcatgagagctctgcttattcagggcacctgtcggctcatctgcaaacagaatacgcggatgattgatcaggctgcggcagatacaggcacgctgcagctgtcctccggatacctcattcacatcgttatccgcaatttcactgatgccaagcttctgcatgagctttgcggcataggcattgatttcttttcttccctgcttcgttcttccctttacagactgataggccggtaaaataatattatcataaacggacaggtttttcagcatatacatctgctggaagacaaatcccatttcctccaggcgcagatcgctgatctcattgcggctcatatccgtaagctcacgctcaaagaatttcacacttccggctgtcgcactgtccatcccgctgatggtatacagcagggttgtcttaccggagccggatggtcccatgacggcgatcatttccttttcttccaatgtcagattgacatttctcaatacgttgttctgtcgtttatttacgatatatgtcttacacagattgcttactgttattccactcataatagcttcctccttattccatattgttcatttcacgtatatggatacgcttgatttgaccggtagcaaatatcgttgcacagatgattcccagcagcagtacacccggatatatcagataaacctgcaccggatctatctggatatgcacatccgcacccatgatggcgaagatcggctccagcatgaagcggttactgagcatggacaatggaactgccgcaagcatggataccagggcaaccagaatcatccgaatcacctgccagctgcgaatactgctgttacggaatccaatactcttcatcatagcgatttctcccttttcacgtacgatgaacagcttttccatcaagagtgtaatcagcataataacagcacagagcatggcagtcatcggaatcagaagctcactcagagattcctgaataccgccgatattgcgatcgacaatttcctgagccgtataccattcataatcaggaaactgcttttgcagggtatccttcagctccgtttggctcttgtctgtcttcatatcaacattgacattccaatactcaaacatgtccaccttacttagatcaagctttgcattcagacgggcactgcttcccagctgcatataatcggcgtagcttcccgtaatgataaacttgtaggtttcaccgttcagatcggcctctatacgatctccgatatgccagttgttatcctccagaatgaggcgggagaaggcgatttcgttttccagcacaggagcactgccttccagataatccagatattccgtattgcgcccctgtatttgcagggacatgattttcgtattgcccttttttccaggagcatgaaacggcaggaagtaaatggaggaggccgtcagctcagcatcatagcccttttccttcatttcccgctccacacgctgcattccctttttcagctgcgcggagtttctgtatgcggaatcctgtttcccttcaattttctttatatatacagcactgtccgtattcacggtgaatttggatgccatttcactgctctgcatggtattgatggtattcagtggaattgtgatcagaacaaagctgatacagaaggtaaccagcagcagggcatagcgtttcagatgcgtcagcatgtcattgatacccagatatgcgggaacacgcagatatttctgtttgaacaaatacaaggccgacgctttcgcaaagctctctccgctgtgtccgccccgaatggcggatatcgcggtaatgcggctcagctttcgtgtacagttcatacagaacagcatgaccagaaagatgatcagcagggtacagagaatatttacaaagaagttaacaccgctgtcctccataatcatattcacactgactcccgccaccatgatacgactgatcggtacgctgatcaacagaccgaggaaagctccgctgctgacaagaaatgtatatttcacaagatacaggcgccgtattgccttatccctcaggccgatcgccttcatgatgccgatttcgcgatactcctcttccattgtgaacagcagggtaaagcgaagaaccagcagagcaatcagaatcatgcagatgcctacaagaattaacagagccgcaagaatcagatcaaaggaataaatcatggaatacatactgcgtgacaccgtattcaaaacggatggaaagctttgcagattctgtgcttccgtaaattcggatatggagcttacattgatgaagtataacgcatacgtctgttcactgcccgtttttttaaattctttatacatatccgaattcataaagattcttgacataccaaccatatcatttccgaacgccgcatcctttaccacggttttcagagtaaaggtcttatctcttccattcaggcttatacgcaccttatcgccgaccttcaaatcgtttttatccatcagaaacgcaggcatgccaatctcatcatcctgcagatgaagagctcccccattcggatcaaagcccttgcaatagtcactgctttcctcggacaggaaaaggctgagtccttccgcgttaaacttctttccattctccctgtgcaaatttttctgttccacagagagcatttcctgataaccgtaatccttcacacccggagcctcggtttctatccatttcatgatcttctctttttccccggaatttactgccaccagattcacatccggtatatttgcataatccatgtagtaatccacagaggagcttacaacaagaatattatttacactgcttgcaagaaataccgtcgcaatggtaataaacagaaacagaatcagattgacactctttctatgcattaaatcttttttcaacattcgtttcagcattgccgtcacaccctttctacaagctaagaataccgcagtctttcttaaaaaatccttaaataccgaagaaagctttcatccccaccatttattcacatatattctttttcaatcagattcaaccacatttatttcaatatcagccatgtattttcataaagaaagcagaagctgttctgaacctctgcggatgctcctgctttgtattcatctttgaaaaggatggcgcaggtatgatctttgtacactatttatgatatggattgttgttctgtatcataaaggcacgataaatctgttccagtacgagcactcttgtcatctgatgggtaaaggtcagatcactcagcttccatttccagttacagcgatcatagacatttttgcccggtcccagagagcctgcgataacgaatgtaaggttactggtctgataggtctgtagctgatcaagctttttggaaaaccgctcactatccaccatttctccccataaatcgagaaggattacatattcctgctcttttattttggcaagaatgcgttctccttccttttccttaacctgattgttctgtgaatcgctgttgctctgcggtgccacttcatcatttacttcgatgatttccagctttgtaaacggccgcagccttttttcgtactcttcaatctgtgtacgcagtgccttctcctttatttttcctactgcaacaatttttatcataagttctcctttacctgcttcaatagctccagcttactctccagccatctgcggcgcagtcttttaaatatccgatattctgcgagcacctcaacaatgccggatgctgtatccactgcgtttaccacccatgcttccctgcacataggtggtatgacggttaacggccacatatgcttgcggatgatctcctgctcccgttcgctgatttgaaaatcgcgcaatgcattgcgattcgcaaaaaaagggtggcgaaagccatgcagtctgtgccaatcctctgcctcatgccagtcatatagaaaatagtcatgcagcagcgcgccccgcaccaaagagcgttcatcacaggacatccgcagctttctgaccagtgtaaagctgtaataggatacgacgaagctgtgctccagacagctgattgatccgtgctgtatatacttctgcatatcccataccctggcatcccccagcagctccttcgctatatttaaaaattccggtacttcctctacgtgcatattccacctcactacgagaattattgtacgctgtttttcatcagagtgcaaatatcagaagccgtactttatcgtagctgaagtgaaaagttaaattccactttcaaagtagctaagtagaaaagactcttacacaacaatctagttgaatttacacttacaattgcatttagtctttcatatatccttttttatatctatgatgaaggtaaccgctggttattatcatacacattacaaagggtgatgaatatggcaacgaacaaaaacaaacatctgactcaggacgatcgcaatgtcatcgcgatcggcatcgttaatggttcctctaaaaaagctattgctgataatctaggcaaagataaatctacgataggtaaggaaatccgtgctcaccgttatctctctcataaatctacactttctctagaatgcgagaactatgctcactgtaagtttaagagaaagaattgtactgtcaactgccctgattattctaagttccgctgtaaacgcagagatcgtactccgggagcttgtaatggctgtgagaaactgaaaagctgccgctttgataaatacctctataaacctacgatcgcctatgaggaataccgtagcgaactcgttgagtctcgaaccggaatcaatctgacctcatcagaagctgtagagctaggcaataccatcaagcctcttctattaaaaggtcattcaccttatcagatcatagctgcacatcccgaacttggaatcagtgagaagacactctacaactatattgaacaaggtgtattcgaatgtgttggcattgctaacattgaccttcgtataaaagtcaaaagaaaaatgaccgctaagaagaagacgatctataaaaaacgacaagaccgtaaattccttgttggacggctttacacagattaccaatcctatgttgagtctgaggaaatcacacacattttacaaatggatacagtctacaatgacatttccaatgggccgtttatccagactttcaaattcatcaaatatgggctcctgtttgctgtatatcacgacacgaagactgctgcagatatggttgacggactagccgttcttgattccatccttggaaaaagcctgtttgaacaggaagctcatataacactcaccgatcgcggaggtgaatttactgatgctgagcatatggaaaaaagagacgatggtaccagaaggacacgagtcttctattgcgaccctatgcagtccgggcagaaaggaagcctggaaaatatgcatcgtgaattacgttatatattacctaacgaagtagacttacgcagtatcggcctgaccgatcagacttccttgaatgtagccatctcacatatcaattccagtgccaaggaacatttgaatggaaaatccccatttgagctatgtgagttcatgtgtccggaattagcgcagaaactttatgaatttggtctacagaaaatagataaggacgaagtgatacttcgcccaagcgtattgactcataagtaacaaacagatgatataaagaatgataagagcggcggcaaagaacagttatttatagtgtaactataaaatggaagtggaatttagttatacataggcataatggagcctattttcagtgcgcttatccattttatctatcattcgcacaatgaccactttcttcacatttttacttacttctacctatttgaaaccctttctaacgctatatttatgctctgtatagacttctgtagaagaaagttccacattttttattcgccttttgaaagtggaatttaacttttcacttcagcgtactttatcgtatccaatacccgttgcaaataaatgttcaatgctcaaagcgtagcctttgacctgcagccgaggatatatcacctgatgattattttataagagcgtcaatgtttcgtaatctccttcgcataagcagtgaggatactcaggaaacaggtatacacggatatttatgtataggcgtttatttcaaggcttatagaatataaaaatcatatcattttttcgtaaaatgtctacaaaccacgaatttcatagtacaatgaaagaaaagggtgatggtatgaaaaagaataaaaaaggatttacacttgtcgagatcattgttgttctggtaatcatcggtatcctgatggcacttgctgtaccggctgttatgagctacgtgcgcaaggcggcagataccaagctgatttccgaagcaagaagtgtcatggtagcctccaaggagaagggaatcgagctggtaaacaaacagcagctggatttactggcgacggatgaaaatatgaaggatatcatgaaacgctcggaagtggaagggaccctgatggaaatatataaaaacaaggcaaataacggtgccggagattttatcgttttgataggggaaacctatatccgatatgatgatcaacagcagaagtatgaaatattgacctcctatgataatctatttgtaaaagcaaacgaaattcaccttgctttgatcaagggagagcctctcagcatcattcaggccttcatcgatcaaaaagataaggcattcatcaattcggaaggtgcaaatgccggtaacagtctgcgcaaggcgcttaacgacgctggtatagccagcggatatgattacagcttcagaatctatgcaagtaaaagtgataacaattatacgataacgataagtgagcgcaaggtaaccttggaggatataaaaaagggaaataaagtcaaggttatccagtatgattattccggaaataatggatttagcggaacaccacgtgttaaaacagcaaatgcttccgttaagcttggagaagactccggaggtacacaggacgattacgctgcattaaagctggatgatatcaaggactgggaggttatctcacaatagccatgtgaatgaaataaaaaactgcaatgcatctgtggtacgcttgaccggtatcactgatgatataagcagtttttttactgatactccttcttatatgccatcttcttaaacatgaccttccattcttcaaaatccttcatgatgttctccaggttgagcgtttcctgacagctgagcttttcatgcatatacccctctgtcatccataccagcatctgatacacctgctttggatcaacatcattgttaaattttgagaaatccacatgcgcaaaaaaacggtcaaaggtcgtgtccatcagagaatgcagctccattgccacatcactgctgacagcctcgcggcgggaagaaaatgcccggcagataaaatccagaataaacggatgctccaccattatctgcatttttttctgcgccccgaattccatcaatgcgaagaaatctgtgatttttgtgaagtcctcatcatccagcgtctttgtgacgatagttacacaatactgaaacagatacatataaaagcttttcttgtccttgaaataatagaataataaccccttggatatgcctgccttggccgcaatatcctccgtgtttgcctttttgtattcatatctgccaaacacttccataccggcatcgatgatacgccgctgcttctcctgtgaaagctcctcgaatttttccatactatatactcctaacacactgatatgttattcaaaaaaagctatgatttcctgtatgctgaccggggccatcgcgtttgcatcgacgcccacatcatatcgtaacagaccgttatcacggtttctgtaattcacaaccgcatgattgtgctgatgtccgtgcagatggattgctccatgataaaagccgttccattccgctatcggataatgaaataagacaaaggtatgtccctcatacttcagctcatgcatctgctttaccatgtaaatatagactgatcaaattccttttgatgaacaaaacggccgtgattaccttcgatcagatactttctgccctttcgcttcttcagcatttcccgggcatacacatgatttttcatggttacatctcccagaatatacacctcgtcatccccgcatatccttcggttccagttttccacaagcgcctcattcatttctttaatataatgatagggtctgttggcaagatggatgatatgatcatgagaaaagtgcaaatccgccgtgaagtatatcctgctgtcacctgctttccctatacatacagctattttagaaaacggcatccgtgcaggatcatgcatcagataccgttcctttattttattccagtattaccgtcttttcgatttctttgccattgcggtttacgacaatgatcaccttgtcctttaccttatgactgtagagatactgacggaactgcttataatccttgatctccttaccatcaaatttcacaaggatgtcaccttcttttattccagcagaggctgccggtgtccgtgaggcaaccttgacaatcagcaggccgctttccaccttggaatcgattcccagatatgccttgtccagcatactcagctgctcgatcggctgtacggaaattccgagaatcggacgtaccaccttgccgttgttttccagctccgtgatgatgggaagaacctcattgatcggcaatgcaaagccaaagccctctacggaggtatccgttatcttcatggaattgataccgatcagctctcctgccatattgattaacggtccgccgctgtttcccggattgatggcggcatccgtctggagaacattcacatcccagtccgcaacaccgttgttgtcgatatccatttccattcttctgtccacaccggatatcagaccaccggatacactgccctgatactcaatgcccagcggacttcccatggcaatgacatattccccctttttgacaagtgaggaattccccatcacaaaggcctccgctttgaaatcaacatctgttttcaacagtgcaagatcggttaactcgtcctttccgacgatatccaccttctgttccttgccgttcgcaaaggtgacaaccgcttcatccccatccgcaacaacatgattgttggtgatgatataaaccgtctttccgtcaaccttataaactgcaccgcttccagtgtcgagtgcctgaccgcgtgctctggcagtaactgtcacaaccttattttcgctcttcgccacaagctctgtcacatcacttgtgatatttacacttgcggtttccaccttctgcttcgtctgctgtgcagcagttgctgctgttgtgtcctcttttgattgcaaatataaaatcgtcaggacgatattccatccgatcagtgccactaggagaaaggctgtcagtcgtttcatgatgatttccctccggtataaatggaaaactgatccgcaggatacaggcggagatcctcgcgatccttctgtttccgcttcagtgtttccttcagtgtggtaagtgccatgtcccgtgtgtttccttcctgggagatatgcgcaagcacgatttcctttgtatgatcccccatgacatcacacaggatgttcgagcagtcctcattgcacaggtgtccgcagtcaccgatgatacgctgcttcagatagacaggccttgtcgtctgcatcagcatctcgatatcgtgattgctttcaaagacataatagtccgcattgcgtatgtattccttaacctcatctttaatatatcccgtatctgtcacatataccattttctcatcctcggtctcgatgacatagcctacggtgccttcacaatcatgactcatcggcagtacggttattcgaaaatcctgcagttcaaagcgatcgtaggggcgtatgccgtgcagatggctggtcgcgatatcctgtgtcgcatatgttggtatggggtcaaacagcttcatctgtgcgatatggtcgctgtgtgtatgcgtaatcagaagtgcattgctctgcatgggatcatagctgatctgttcaaagcagcttttcagatattttcgcgttgttccacagtcaatgaccagtttggtatccttatgttttatcagacagcagttacctttggaaccgctggccagtagtgcaaatttcatatgcggcccccttttcttatacgatatgtccacttccttgagcccttggaagaaacaggctgtcgcatcacagccggtatgctatctacatgcaatatgcaaaaagttatataacaactatttgacactatgagaatccgtcgtgtgcaatgttgaagaaggcagatatggatttctgaaatgcaagctccaccttgcctgtcgcaccgttacggtgcttggcaatatcaagatcggtctgatcggtcggattgttttgttccgcctcatcatccttcgcataataggcatcacgatacagaaacatgacgatatcggcatcctgctcgatggctccggattcacgaaggtcggacagcatcggatgcttgtcgggacgggtttccacggaacgcgacagctgtgaaagtgcgatcaccggacattccatttctctggccagtcccttcagggaacgggaaatttccgatatttcctgctggcggttatctccgcttttcccgcttccgctgatcagctgaaggtagtcaatgacgaccagatcaagaccatgctcacttttcagcttacggcatttggagaacacctcggatattttgatattggagctgtcatccacaaacagcttgctggccatcagttcattcgccgcttcgttcagcttgctgaattcatcatccagaatagcaccgcttctcagcttattggattccactgcggacttggcactcagaatacgcttcatcaatgcctccgccggcatctccagtgagaagatggcaattgccccgggattgtaaaaggatgcattcaacgccagattcagcgcgaaggcagtctttcccatcgctggacgggccgcaagaataatcaaatcgccacgctgaaagccgttggtcatacggtcaaggtcggtatagccggtcttgattccggttacacggttatcactggtgcgcagacgaatcagctcctgcatgacattggaaacaacctcccggctgcttttgaaatcagtggcacgacggctgcgcgtaacaccgagaatatcccgttccgccttatccatgatttcatccagatcattcgctgtatcaaagccgtcctcggcaatctgttcagctgcttcgattaagcgtcgcagatgtgctctgcttttgatcatttcaatataatacacactgttggcgctggatatcgccgtatcactcagcttgatgatatagtcagcaccgccgaccagattcagctgctcgatatcctgtaaacgggcaatcagcgtggtgacatccaccggcttaccgctgtccgtgatatccatcatggcagagaatatacgctgatggatatccagatagaaatctcgcacatccagcccctgatcatatacaacgctggttacgctgggataaatcatcattgcgccgagaatggactgctccgcctcggtgctatgtggcaattctctactcataaagcctcctatccgttcacatgaacacgaatggttccgattaccttatttctgtaaagatccaccttaacatccgtatagcccagagaggtgatggcatcgttatcgatgacctttctcttgtccacatgaattccgtatgtttcatgcagctgtgcaacaatctgctttgtggaaacactgccgaacacacgtccgccttctcctgttttcacatggaattccagcgtgatcttcgcaagctgctttttcaggtcctctgcatccgcttccttctgcttttcctccagatcatgctgtagattctgctcatccagaatctccatgcttttctttgttgccattaccgccaggttcttattcagtagaaagtttcttccgtagccgtcactgacctctacgatatcccctttctttcccagcttctttacatcacttagcagtatcactttcatcttcgtcgtcctccttgttttcttccagataggtatctatcatctgtttcaattcttcctgtacggccttcaccgttgtttgttctctctgcagggcagccatcgtgaaatgtccgccgccatgcatattctccatgataatctgtacgttgatcttccctttactgcgggcagataccgccactttgccgttttcaatattaccgatgacaaagcttgcctccatatccttgatattcagcaggctgtctgccacctgagacatcagtgtacggttgattacacggttgttatcaactgcggcgatcagaataccatccgcatattgtcctgcatatttcatgatttccgtttttgcctcgaaatcatcaaaatcctccttcagaagattctctgccgtaatcgggtcaactcccagatttttcagataggcagcagcttcaaacgtacggcttccggttctcgtcttaaagcggttggtatccaccagaataccgacatacatcagtgttgcctcttcctcactcaggtttaccttattgttctgataaggcaggaattcggttgccagctcacatacggagctggcactcgattccacatacaccagcagcggattaccgatgaagtcctcacttctgcggtgatgatcgatcacaacgatacggttagctgcctccagtgtctgcggagctcccgtctgttttggattgtgatgatcgacggcaatcagtaaatcgtcgttttctatcattttcgcggcatcaccgtcactgataaagcggtgccgtccctccagcttctcccggtacagcatcaaagcctcctgcagctgcggttcgattccaccgccatccgatacaacatatacttccttgccataggcagcagccagccgtgacatacacagcgcacttcccatgcagtcaaaatccatattctgatgaccgatgacaaacacccggtcggcttccataatggcttccttgatcgcctgcgacatcacacggacacgcaccttgcttcgtttttcacgtgcctcactgttcccaccgaaatatttcacactttcgccatacttcttgacagctgcctgatcaccgccccggctctgtgccagctccagaagatcattcaccatcgtatccagcagacggaaatcatccgtgccacgggcaaacgacatactcagcgttatggatacatcgatatcctcagcgtttttacgtatcgtattcagaatgtcaaatttatcctgtacgacctgttcgaaaatcgcctcattcaaaatgacgagaaagcgatcggagcgcagacgccggataaacatcccgtagcggcctgcccattccaccagtggctgacgcagctgtgtattgatggttgccatggttccttcatcctcatactgctgaatttccatataattatccagctgcagcaatccggcaacgatactgtccttcttaaaccgctctgttatggtctccagcttggtgatatcacgtacaaacagcacctgtccgttttccttgcgggcaatctcatatacatattccccattcggatcacttgccgtcagctcgtccacagagccgttgaaaagatctgtaatctccggaatccagctggtcagcttttttccgacaacattaacagagcgctcctccagaaactcattgatccatgtcgcattgtactgctcatcatacgtaatgataccaacctcgccaaaggacagggcatccttggcgtcatgtcccagaatatgggagatatcgatatcccgctgttccttatcacgctcatacttcaatacgatccaaatgatgacaaggatattcagaatcagcagaatcgtcatgggcagaatctgaagacccggaattccggccatatacagcacaaacaatgccgcagcttccgcaatcagtataattgcgatttgaaccttaaaattttccaaacgatccatttatgacacctcgtttcattttatctctcagcagaaacaggatatccgcaatgccgattacggcaatgacatcctgtacatagggcacaaagactgcaatcatcaacagcaacacaaatgcgcgctttcgtaacagcaccagcagtcccatgatacacatcgctccgcaggcgattgcatggaccttgcagacaaggtaggcccccagcagtatcgtcgaagcttcctggtttaattttagcacatttccactgtaaaatagaacccaaatgacaagaatcagccatccgttccatttcgaagcacgaatactgagaatattgttcatcggatgcaccctgatatgcagacgggaaagcaggatgtttccaatcatatggatgcacatcgtctgcagcacgctcatgagaacagctaccagaacaacaatgatcgttacggttttcatgagatcgattccggtatggatgttcataagctccagtatggttttcaccagctcgatatcctctgccggatcatacccgaatacagccgcaagcaaaacggttgtgaccagataggaaaagaatgtgaagataccgctgaaaacaagcagcgtaccgttcttccagccttttctcaccccgccaccatatacaagtcccacaacgatgcagctgaagagataaaagatcgttgtcggtgagctgatcatgaaggaaagcagcagcatactgacagagggaaccagtgcattgtgcactccgtattttgccgtatagacaagaatggggaaggtcagtacccagtacatgaaatattccagcatattgccaagctgccggttgataaacaggaccagtccgacaatggcgcacatcattgccccttctgttatcttgcgtgtctgcttgttcatatcatctgcttcctttctttcttcatagtgcctcagcaatgctccgtgccgccctgtgcagggatacagctatgaaaaaactccatcctgcgacagatggagtgaatatgcgatattattcgcttacgtaaggcagtaaagccatctggcgtgcacgcttgattgcagtagccagcatacgctgatattttgcacgtgtacctgttacacgtcttggaatgatttttccgtttgcggaaatgaatcttttcaataattcaatatccttgtagtcgatgctttcaattttatttttcgtaaagtaacatacttttttacgtcccatacgctgttttttgaatgccatagaaaatctcctttctaccattaaaatggtaaatcatcacttgcgatatccagtgtatcgctgcttgtaaagtcattggagtaggactgggagctgctgttgtcactctggtagccctgattgcttccctgatcataatcaggtacataggcattgctgttcgcattgcttgcggcagcgcttttgctttccagaaactgtacgctgtctgcgacaacttctgttacataaacgcgtttcccactctgatcatcatagctgcgtgtctggattcttccttccacaccgaccagtgatcctttatgtgtatactgtgatacgatatccgctgttttattccaggcaaccgtgttgatgaaatcagcgtccggctgtccctcctgcttgaaacggcgggtacatgctacagtaaaagaaacaacagatgcaccgtttgcagtcttacgcaagacaggatctttcgttaaacgaccgactaatacgactctattgatcatatgtccatcctcctaagtcttactcttcgtcctgagttttgataatcatataacgtacgatgctgtggttgatacgtgccagacgctcgaattcgtgaattccttcgttgttggcagttgcatttacgacaacatagtaaccttttttcatgtgattgatttcatacgcgaactctttcacgccccattcgtctaccttatcgatagtaccctcgtggtcagtaataatcttgtggaaactgtccatcagtttagtgcgtgctgcatcatccagggatgcgttcacgatgtacatgatttcgtattttttcattctgtacacctcctcgtggtcttaaggccctatatccgttatgtatagagcggggagtagagatttctacccgtctattgattatagcacggggaagggatgaagtaaagtgataatttgactttttccagatggcagagagctgctgttgttttatttgagcaaacagatggcagatcgataacacgctgtggttatccttatatataggaatgtattcatggcgatatttctgatagaatcacgttttaattagcgggataagaaggaagtgagcacatcaattcattgtaaaatgtattgacttcataccatataatgtttatactttaagtactgagacaaaaggtctgtaaagactggaaaagagagtggacagttggagccgtacactctcttttttttggaggtctgagacaaaagggggtgtgtgatttctacatgcaggataaggactgccgcaaaaatgagatcagttacatagcgttgttacctgtggctccgccgctcgatgagatagatcagcgtcagaaacatcaggtacgctataatctgatccgtatgtacgccccctttcttcagcacacagaacctcatgcccatactgacacctccactattacatacggatttttatgatcgaattcctaaattttacatcatttccttaaaaataacctatataaaaattagataatcgtataatgtaaagttttttcattgatttcaattataagaattcctcacacaagaaatacttttgttatgtaacagctgatattttcaatgcgatacagttacactatttacctgttttattctgtatctactttgagcttttatttgcatcccaatatgaaaataacgtcccgttacataccggttctgagtgctatactaaagaaaagaaagaagggattcgatgaaactgctgattggatcagttacgaagtgtgaagaaattaaactggcagtcctgtccatggatttaccgcttatctatcagggtaagaagggactgcagatggttttcgactgtgcatctgatgaggatgagaaaattattctgagaaaggtaaaagacgaattgaagcagctgccggagcttggcggcatcttctacaatgtgacatgtggataagcagatagcctgtagcctcactttacagcacaagaaaggaaagcacttctgatgaattacagaatcatgctttcctttttcatacagcttagtttctgtttctaatactgtccgccctggcttatgttacacgttgtcacatgttccttatttatcaaatagaagaatgctcattcttctgtttttcaacacaagtcactctggttttcgcaagataatcatgcagtgcgcgatgcgagtctgttttcattacaagaataagggataacgctgtaagaatcatccctgctaactgccagtaataatctacataatagctcagtgacagggtcaccagctgccggatatagtttgatgtgacaaatgctgcaccctccagcaggaagccgccgataacctgccgttttaacagggtaatcaaatccactgctgtaccatccgttttttccatgcggtaaccggcaacacgttttccaagtgtctgccccggccagatacgccatggaacatatacataataaaacagcgcaaacaaaatgcagagtgccccggcaagaaaggcccagctgcgtgcataaccaagtgattcaaaaacatacaagccgccaaatcatacaattcttttatgatgattagcattgaaggactcgcgtctattttaaaatgaactactcaaagcacacgctatccggtattcaaaaaaaaacagatgaattcaacttcaaaaactcgatcgacttctatttgtctcctgattatacgatagatattgagacagaaagtccgaaattgtaaagacagttaaggcggtcggttctttcttactttagggtgtttacaaacagagagaattcaacttctattgataaatatagtgttaaattctccctgttttaaatttacccacaatcaagtaagaacctcggctaagcaatcactctcttttttgtttagaggtctgcaatagaagagatgtgaagcattgttaccttcaggataaggactgccgcaaataagggaaaaccactactcatagctttttctaattagaaatgtcagaatattgtttccggtctttcccgacacggtgtaccacttgcatcacaggatctattgagtgcagcaactccccatccacagccccatgcaaaatcagctgtagaacggaactgtgtgattgctgaggatacgctcatcgttcctaaattaatcacttcaatatgacaatgcgcacctgtagaattgccgctatgccctgttaatgccagtaattgtccttttttaacctgagtaccagctgatacagcaaaaccttcacgcgataaatgaaagaagctgatagcatatgttgtaccacctgcctgtatcagcatatgaattgtattgcctccacctgcaggataaccaacccagttattgaggaatccaccgttagatggtaccggattatttgcatataagatgataccgtcagcgggagcaacaagagatgtaccaaccggtgtcgcaatatccaggcctaagtgaacaccaccatccggatatgcccaggttcctgcagatacgctgcccccctgaactggcataattagtgtgccattgctgctgaaattcaatttccctgctacagaagtattaatatcgatcatattattttctatactggcgatatccacctgtacagaacgcatcttttcattcaactcagcttcttgtttaagatacttttttaatagctcttcttcctgtttttttgccttttcagtctcttttttatgtttctcattctctgcttttttcgcttcaacgtcagctttcagacggttctcctcacttttttgatgatttagctcatctttatctttctgcagcttcttgatttctgtctgatcactgtctgtaatccttcgaagtccatctactttacgaatcatatcgacaagattattggaacccatgattacttccacattcatattagtaccgatcactgcctgctcattaagcattcgatctgtaataattttattacgctgatcgatatccctttgtttcttttttatttcaacattcagcttttctatctgaatttcaatggtacggatattaacctcattgcgttcgatgctcttatctagtttatcaatcaaggactgcagttgtttcatcattgtactgatttcctcaatattatttttaattgatgaaattttggtatttaatgaagacgcttcatcttccaaatcagaactgatacctgcgtaatactgcttaaacctattacatttttgtgcttctgcttcactctcttgtgccacactacatttattcagccagttctcttctttaccttcaaaatctacagcatataaagagctttgatttaacgatgcaagcagacagcctgacaatgctgtgtacaatactgctttgatttttctatttgtcatatctacctcgtttttgtctatacctcgttaacttatacagaaagatatcagagccagtagttttccggacgctctctgcatggtgcgctgccacaggcgttcggtgcctctgcattccaccctgttccaaatgtaaggtcgttattactgttataaatattcaatgcctcagacatactcatattaccaacacgaatgatttccacatggcaatgattccccaaactccatccggagtctcctgaatacccaagcacctgcccctgtgataccttctgtcctggggtaactgcaatagaagtcatatgataaaatggcattgcatagatagtatttcccttttttgtaagaagcaatacattatttccaccgccaatcggaataccgcagttactgtaaccatttccacatcctgaatatgtatgaaggatgactccagctgcaggagcctgtacagggatatttattgtacctcctgtagagaagtccatccccatatgaccgcctccgccaggataatgccatgttccagattcataatgccatccataggatagaggtaccagaaaagaatcgttatttgaagtatcattcgggtgatttggaaccactggttcctgaggtgtctgcgtatctggtttttcaatatcattattggtattgttgtcaggtttagcagtatccggctttttcggcttatcaaattcttctgctattgccaggtcaattttaggaagtgatgtctgggccatttggatctgacgcttctgcgcactcagctttgactcctgcttatgatagccgttcagtagttcctgcttcacattgttcagtgtttcaacccgcaacttatcatcctttatattgttttgctgctcaattagaagctctttttgctctttcacaatggcgcgatcctcgttgagtttttgcttttccttgttgagtatactgatttgttcgttttcatacgtgtttaattcaccaacgatttccgtgcgacgcaaaagatcaacaaaacttgatgatcccataaggaaatcgatatagtaattgcttccggtgtaagcctgcatttcaatcagacgttcgcgcatctgtttatcacgttctttgatatcgttttccttctcactgattttagcattcatatcctcaatggagttttgcatagtttcaatattcaactgaactttatgtatctgtttatcatactgctctattttttcattattctctttaatgagaggagcaattttatcaatattccctttcactttgctaatttgattttttatttctttgatttcatcatctaggttattcgatttgttctgtaaatattgtttatactgtctgcataatccttgtgtttcagaatttttgatcacttcacattttgcattcatttcatcttctttaccttcaaaattttctgcatacatgaaatcgtaattgctgatgaataggatacctgcagcaaacaatgctaatataagccctttttgtttatgaagcatagctgttttttccattttcctttcttatactcctagtatctttttattattatctaaaaatgctgcatcaccattgcaatgcagcattcccttatttatgttccgttttcaaatttttaactattaactacaactaccatatttattattcggattatgttcgtatagaggccctgcattcacccaaacatacacatcttttccccacttatctttgaattttaattttacagtattagctgttgcattatttgcatatacataaaagcctaaattatgtatttgcgcaaatttaccatctggatgaaaatattctccaacacgaagtatttgatctaaactgccagtaccgccaacagaactttgatacacctcaatcaaggaccaagcgggtaaccaagctttcaaattattattataaattaaatcctttgctgcatctactttatccactctgtatgaagtcataccactatttcgcggtgaaaactgtgcatattcgcctggttgaagtatatcatcacaaggattcattaccgctctcccatctggattttcagtagtcgctgctgtaacattagttcctaacagaggtattgcaagcatcatcattaaaaccattttaccaatttttttcattttttcttcctcctataaatagttaaatatattatattacaatttttggttaattacaatcgaaattatataggaacctgcaattcggacgaaaaggtattttgtaaaagataagaaagagttatagtatagatgaagggatggtgatggatatgctagcgaaaaaagataaagaaaaagctattgagttcttaaaagaaggaaagataaaagacctgctcacctatgttcctcaggtagctgatgaaattgtcatcaatgctgaaaaacatcataaactcatttctacttttgatgaaacctttcctaaccagaattcacacagagatgctattcctcctagtgtttttcttacattaggcctattgccagactgaagaatttccagtccatggcttcttttcctcttgccactacaaacccatatctgctggagcatctgaattttgtaattcataccggaaaagaaggtcttttcaacgaaaagaatgtcagaatgttttcgaaaaagtataagggcagcttatttgtggaatatacgaatgatttcctcttaaaactttttggaaacactatatttagaaatatgcataacttcagttatgactgttctgaaatcccagtcaacttaaaaaatgataagtttgaacattcctcagtgattactgaaaaaaaggtgaaaagatcagaagatataaattaggggttttacgtggtcagctgccacatggtggcggatccatgtcagattgtattcggacagctgaaaacccatgatctgaatctctccagagattccctgaccagcagtccgtggctcaaaaaaggtgacaacctgaatgttgacagaggattccttgatcatctgcttatgagggatttcaatgaaaaaggagtatccgtcacagttcctacaaaaaagaatatggagatatacaaagaggctgtagccattgctataaaagaaaatgactggggcatccatccaaacccaaaaagaaaaaaacagaagatacagctggtaaaggatcttgcgccattttaccagggagatccggcaaaagaagaatctgatggtatctgaagacaagaaatatgcatatgcagtaatactgtgcactgatacaaggctcacagcaagagaaatcatcgaaaattatgaaacaagatggcgatgtgaagaggattatcgtcagctgaaggaattctgaaaactgaataccttcacaactacaaggtacgaagggattcttctggaaatgatatgctgtatcattgcatacgcattatgcgaactgtataaagaaacaccaaaaggagaaaagtacagaaagcattgcctgatgaaatatatagaatatgacaggaagttattcagaatgtctgaattgggctgtgttttggtagtacctcattattatgtagttctggagatgaaggagatcatgaaattgtacaggtattgcgatgaggagacatgcaagttgattgataagaaaataggcagttagctgaaaaaacgcttttcaaaaaaatcggggccttttctgcgccaaaataaaaaaatcagtctttcatctcagagattatgatagatctcattatattgactgattttttttgcatacattaatttaaccctatcctatggtctaatttatcttttgtccgaattgcagaaaaaaagacacctatacttttttgtataaatatctctcatctatatttctttaacttaatgacattggcatctagtgaaatttttgttactattcacagtcgaattcaattgtatgaaactcagtttaatgaaactatctgtaatgaaaaaagtacatagtcttgttccaactcttgaataacctacattcctatgagaaatcacatattttagctttaactgtgaatagaacaaatttttaattacccctgatttcctcttttctcatatgtcaacttccttaactcttggcagtgccttattgatataggtttaaattaattatttatatttccctatacgtaaaacagaccaaataattacagtaaatgtatagttaatctcatatatccatttgaataccataaagcatgaaattttaatatttcaaaaatcactaattaataatatcatatatttttacaaattaatagtctagttatttaatatagttttatatataattaaagtgtaaaaattagggtcatgttgaggaggagaaagaaaatgaaaaataaattattggggtatccaaaatatttggggggctaaactttaggggtcaatttaggggtctgaactttgagggacactttagggggataaatcccaaaagaaacaggtggcattcatctgtttctttttctataatgttctattggttatgcttctgtgaaggaggtaatcatggatcattcttatctatttaaattattaaacattcccgatgatggttctattatcatcaacgatgttgaaatcatcgctgataccaagtatgtatatatctctcgaccatctatcccgtcttattgccctaattgttcttgcagaatgcactcaaaaggtatttataagcgcaaaatcaaacaccctgtcttacaagacggaacttgcatcatctttatcgtgagccaaagaaagtggaaatgcactaactgttccacatatgttaatgaagatttcccattctttcagcgttataaacaatcctctgatattactcctctactagttttagaggctatgaaagaccttgatcgttctaccgcatctattgccagacaattcaatttatctgatactcaagttcacgatcttttcactgcttacgtggatttgccacgtttaactcttcctgagtttctttccgttgatgaagtacatattgatatttctgaaaaagagaaatatgccttgattcttatggactttacttctggagagattgttgacatcttgcataaccggtggcatcataccattgaaaactacttcttctccattccatacgaagaaagaaaacatgttcgttatattatttctgatgcatataagccttatcttgaattacccaagcatttctttccaaatgctgtgtcgattttagatagttttcatgttgttaaatatttattaggattgattaatacttatatcaattcagtaatgaaagcatataaagatagagatcttaaaaggcttgaaaaacaaaatcatgacaccaatagagacaataaaacgattcaggaatcacaagaagttatcttgcttagaaaatatcgctgggtgcttttgaagaatcaagacaatatcaattactctgacaaaaggtattaccacagctctcttagaatgtacgcagatacatatactattgaaaaactatttctctcactagatcctaagttcaatataatcagagatgtgaaagaaaaatatattagattcaataatactcactttagttctgaagatgaagtaatgcaagaattattaaaaatgattgaagaatttaaggctctcagaggttacattcctcgtcttttctcacaataccttgataaatataagcatgagattgcccgctcatttactataactgaggtatcaagacgtagtgcaaaggataatgagcgttactatgcacgtttatccaatggacctatggaatcattcaaccgaaagccgaaagattataagagaaactcacgaggttcctctaattttaattatactagaaatcgaatcttatggtctaccagaaatagacctgcattgagaaatacgcccaaatcatctaatgaagtacatagctatgttggaaagaaacgtggtaaatataaagtaaaagaataaagagattaagaatttgtacagaagcataaccaaaaaaagagaatcagaatgttttttcactgattctcttgattttaactttaggggtcttaatttttagcctttattttttctctcccccaaagttgacccccaaatttctggcgaaaacccctaaaaaatttggatagccaattcatcctgattaagatgatattactcttattaacctcactataatactatagagcatggtatttatttctcataaaggagcttatcaatcagcgtacaacaactgctttttcatagaattatagacactttcaaattgtcctttgctaatccacaatactccgaaataaggatcattatcttgtatttacctttctgccgttataaccaaccaaagggcttcaatttatactacatataaattcccagacaccattttatgaactcatataatgcagaacatgtaattcctacaagaatatccttttcaatcgtataactatgcttcttaatatactgaacgatcccggttttatctttttgtatagcatatgcgtaaatatgttcaagtatttctcgattttgagaatcctccgtttttgaaatagattccagcaattcttttttcaaaagattccaagtctccgtactaacttcattagtttgaatattgacttgattattatcacctattattgaattagatatgtttgaataattcttataatttcccataagttactcctttatattttcaattccggatattcatcagcatccggagcctgaactttattatcactccctattattgaatcactgatatctgaatatgaggtattatgttgtgaatgatctgtatatgccataatgccattatttatgatatctagcttttcaaggttaataatgacttcattttcaatagcgtgtccattcatgatatttctaataacatctataacctttaaagagaaatcatcgtctttgctattgatccagaaactaaatccacttcctgtagatataataatatttttcccaagatccttatttttttcccaagtacgataaagcatatatccagaaattgccgcactaatcaaaaacataaagctgataaactttatctcagcagcagtcactgtatagaaaaaaatataaaagcttattatgaaaatacctattgcataaggcgaatatccatacttaggcggataacgcagtgatacactggcaacattcttaatttgaattattgcatcatccatttctattatgttcttctcaatttttaatattggtgaagaaagtacatttacatcagcttgataattcattctaattccctccatttaaatcccattcggctacttcagtttgaccattatcatctgcttttttactaatttcagtatataagatatgtccatcttgtgttaaagccacagtgtgaagccatccagcagaaatctgcacaacattgctccattcagctacttcagtttggccaaaattttcttttttatcaagaatttctgtagatatcacagttccatctttacggagtcctatactatgaaatctacctgctgaaattgcaataatatcacgccaacctgaaacagaacaacgtccatctttttcatatcctatcgaaacaacagttccgtcatttcttagtcccaatgtatggttcgatcctgacgctatttgtactataccgttccaatcagtcacatccgtttcaccaaaatcatatttttcattattgatttttgtagatacaactgttccatccgttttcaatcctatggtatgatcccatgctgcacaaacctgaatgatatctgtccaatcatctacatctccttgcccaaaatcatacatatcatcaatgaatgtagaaattactgtaccgtctttgcgtaacccaacggtatgccacgtccctgctgatacctgaacaatatcagtccatctatctacttctgcttgtcctgtatcattagaagtatttattgatgttgaaataacagaaccgtcatctttcaaacctacagtatgatattcattggaagatacttgtattatattctcccagttcttcacattattttgtccacgattatcttcagatttgtgaattgttgtagataacacagtaccatctttttttaaagctatcgtactgtatacacctgcctcgatttggggtagattgtgattttcagtctttactgtctctttttcagttttctgctctattttagcagaagcagtgtcagaaatattttcattgtcatgtgacatttgctgcatcactgtattgataagaagtgcaatcagaattagagctcctgatccaaccatgatagccagcttctttctcctctgttgatttacacgcatctgggactcacatagctgtcggtactctacctcacgttctttcagatttcctagctgcgtgaccatttctgttgttatcagctctccggttatcttctcacaatactgtcttatattttcttcaaagcttaaatcaacagataaggtaagtttttcatcttctaggaatttcttaattttgtcagttatcagctcttcatgctttatttttaacgaggccttatccagacatgatagtaatttgcttttatctaaaccgtaagtatcttccatttttattgcataattttcaagaatattgtcaagcgtctgtagctcatccattcttaaaaatttatctggctgcttataagccctttctcttaagtcttcattcatcaattcaatcaaattctgtttttcagaaccgcacgattcacagacatctgattttgctgtattacaaaacccgcaagaacagacccaaaatttatcctttattaagggtagagtatttacagttaagtctgaagtataatcatttaataaattcaattgctgacgatcatagtttaacttgatattcgaaactatatggccattcacaacatactcttctccgtcagcaatatagctaattaaagataaatctgtagatgtgtcagatagctctatttcatatacaaaacctagcaaattttgattttgatattctgaaacgtattcaaatcgtttaattgtaaattcctgtccatgaaaattaaatttcatttgcattaaatcatttgttcattgaaaaatcgattatacctttagaaatcttctgtatatgtcatcacgctttacaataatattttcgatgctataaagccaatatactgaatctaatcgattacgtataccgtctttatccatgcaattatagagcacgtaaaataaatcatatttaaaaatttagattataagtatcagtatgcaaaaaaagtcagtctataatgcaataaaatctgcaaaataacctgactttttatttaaatattattcatcggctgtgttttcttccataacctgttgagcaagagcttttacatcttctccgttctcaactttctttataacttcaacagcacgtttcactgtattgacatttggttccatcacccaggaattaaatccgtttgccggtgaccatgcactgccattaccggttccattaacagaaatttgttcaatatcccagccactcatatcgtttatctgcattttaatcaaagatgtcatttcgctgttactcatatttgtctggaagctaccactgactgcatccaaaatactcgtataatttgtaataattgatggtgaaattgctttatttatgattccggtaataactctcatctgattcttaccacggtcgcggtcaccgccccctaaattataacgttcgcgggcaaagcgtaatgcttttgcaccatccatataaacatctcctgcttcataagaataagttccatcacttgctgtaaatgctactggattattaaccgtgataccacctaaagcattaacaatattctcaacgcttgagaaatttacacgtacataatagttaatatcgataccaaaataattttccactgtttctacggtgcagtcaactccaaaaataccagtatgtgtcagtttatctgtctgacctgcctgacatggctgaggaacataatagtcacgaggaatgctagttaacaaaatctgatgtgttttaggattcactgttgcaatcatattaacgtcagatctggatactgttgatattgtcccataagtatcaatgccagtaatgtaaacattaaatggttcagaagtcacatttacgtttttactaatatctttagttgtagtcttatatttgtagctttttacaatctttgtttctgaatcaaatttagaatgattatcctcaaacaagcttcttgtggcttcatccataataatagcgtcaattttcccatcatataaatcatcagcaatcgttttatatgatttatagtctacagtggtgatatcctgtcctgcatctttctttatgtcctcaagtcccttttctatgatatcctgcgtaccagtttttgttaaaccaaatttactgttttttaagtcctctatactccctgctttactttctttcattactactacggatacaacggatgtctgtgtatcatcaccagtcattctggagaatgctgctcctgttttaaagaaataccagtttcccactcctaagaaaatagataataaaacaattaacactctacctaagattttgtttatcttatttacttttttaccaagttgtaaatagtacattcctgaaaaggtaagtaataaaacaatacaaataattgtcgcatatttcataggaataacatttactgtaaatacttgcacaattaaccctaatgttaataatgcatatagcaatacaaagtaaaatcctacgtttttatataaaggcatttgctttttgttatgtgttttctttgccataaccatcctcctcacaaaatcaacaattttattataaactctttttatctatttgactatatgaattgcattacattttcttaatatattaattaccaaagtaaaatctatcccttagtggaatttagttattcaaatatatatctctttttattatatgtagaatttagtaattccttacttcttaatcttacttaaaggaggttatctatcatgactaagaacatacactttatcattcaagggaaaaatacaatttaaacggcatgttgtaattatcgaaaagaatagttgaattagattgttaaatacagaaatagcttatctgacgaaatcattataagctgtctctgctatatttttatccactattttattttgcgcttactataaaactaatgtttagtgataaaagagttagctaagtttctacctaactaactcttttcatttctacaccctcccaaggaattacgcaaaagttaaaccctaaggaaattgggaaaaacaaaaaaaggatacccaaaacagatgataattagatattacactcttaaaatcatctgtttctcttctttataaactttataagcatcatacatcatttcaaaaaataaatgaacttacttgcccagtttgcaaatttttctttttatataattcttttacttcaaggatgtagcaaattaattgaaaattggtgaaacaaattctataaaataatcttctgtttgtataatatcttgtacaataacataccctgctgtttcatttgcctctaatatttgaccattccccatgtaaataccaacgtggtgtgtatggaattctttcccatcgctactagtccaattatggggacagtttgtattatctccaacattttctttagaaaaataacactcttttacattccaaaaaattaagtcacctatattaatatttgataatagttgttcttgagactccttatctatatcttggctaatgaaatgaggatagttttcataaacatattttgattgttgatatgaatatcccttgatatcatttttgtctaataaattgtatacatattctgtaaatagactacaatcaagttgtccttcaccgcggccataagtcaccccaatctttttaagaccttctattattaacctatctctaacacttcctgtagtagacattacagaatttatatcaactattccattggaattaatattaaacgataatgtattaatattaatatttttatttttttccattattcctgtttctttgttaaagtaatataagtttccttgataatattgaaattgtgtatgtgcataaccatatacaggatgtaaataataagtacttccattataatcctgcatacctttccttaatccatcattttcattaatatcaaaataataatatctaaatacagtattactaaaagcaattccactttctaataaagcaccactgcctaaattaaaataataatttttaccatttaatatttgatgaccaaatctcattaccccataagtatttggattatccttagattcattaaaataatatgttttttcatctatagtaataaatccagttttaacatcccctatttttgtaaaatagaaagttgcttcgttatcttttcctggatttactgttcttttaccttcaatggcataccctaattcttcatcaaaataatatcttttattatcttgtattttatatccaaactcttgtactcctgtttctggattaaagcaaaatgtgctatttcctattttttgaattccttttgcaacatcaccttctggtaaaaaataatacattattgtaccaactttaataaacccagtttccattatacctgtcatagcattaaaataatatttcttactattatagattctataaccgaactcttgtactcctgtttctggattaaagcaatatgttctatttcctattttctgaattccttttacaacatcaccttctggtaaaaaataataattactattcccaattttaataaatccagttagcatttcaccagtctctttatcgaaatagtactttttattttgaataattttatatccttttgctttagcacctgtttctgaatcaatataatatgttttcccgttttctataataaatcctggattatcctttattgaacgaatcatacactttgtagataatccattcgctgtttctgcatacacatatgtattccctatggattttgctgttaccttcccatttacatctacactagctatttggggatttcctactctccagtttacttttttattgctagcgtcttccggtgttattgttgctttcaattgaaagttttctcccatttttataactgcatccgtctcattcaattttattcctgtcggcttgatttccttcgctgtaacacggattatgcatcttgcttccaatccattcgctgtttctgcatacacatatgtattccctatggattttgctgttaccttcccatttacatctacactagctatttggagatttcctactctccagcttacttttttattgctagcatcttccggtgttattgttgctttcagctgaacgctttttcccatttctactctaatatcagtctcatttaatctgattcctgtcggcttgatttccttcgctgtaacacggattatgcatcttgctttcaatccattcgctgtttctgcatacgcatatgtattccctatggattttgctgttaccttcccatttgcatctacactagctatttggggatttcctactctccagcttacttttttattgctagcgtcttccggtgttattgttgctttcagctgaacgctttttcccatttccactctaatatccgtctcatttaatctgattcctgtcggcttgatttccttcgctgtaacacggattatgcatcttgcttccaatccattcgctgtttctgcatacacatatgtattccctatggattttgctgttaccttcccatttgcatctacactagctatttggggatttcctactctccagcttacttttttattgctagcgtcttccggtgttattgttgctttcagctgaacgctttttcccatttctactcttatatccgtttcattcaattttattcctatcggcttgatttccttcgctgtaacacgaattatgcatcttgcttccaatccattcgctgtttctgcatacacatatgtattccctatggattttgctgttaccttcccatttgtatctacactagctatttggggatttcctactctccagttaatttgactatattctcctaatacatctaattgaatattttttcctaattcaacggttacatcattttcacttaatgaaaaatatttgaaatttttttcggatcctatacaatcttcagtcgatattgcatttagagaaatagtttggccaaatagtaaacaacaaatcactgcaaacaatactactttttccataattttcactcctttttagtttttttggtagaaacaattttatatatatatattttatctttatttttattatatataaatttatcaacttctttcaatctcttatcatatttactttcaagtaatatttttacagaatttaaggtatcacctgtacacgcataataaacattttttctatttaataatccatctatagcatgctcaaatccataatttttatttcgctgataataaattggagaagttgctagccaattccctagagattcagtattgacgatatgcgtttgttcccttaaaacttgatcagaagatgctataaaatctttcgcattatagaaataaaagttttttggattatttacagcatagttgtttaaagcatataattttgatgcattatttgcagaaacttcttcttgattagctaatctattttgatttgaaaaaatgaaactaataaaaattattaaaaccaatataattgatgaaacacgtaacaatagtgagtaaaaattatttgaatttatcgaaatagagggtaatcgattatttaaaacagatagatgctttgattctaaataaattaatatagtagaagatataaggattaatgtctcagtcaatcttggcattattcttccgaatataataaatactattactccgcatattacatatccaattgttccatttattaatagtttactaattgaagaaaagccttttattttagtttcaatataccatgcaattcctaatactaaaacaaaaaacatgacttcaaattttacaatcgtattggtaagcccttcaaaagattgagtaattcctttatatattctatcaaaaatattgattttataaattccttttccatactctataatcttgtcatacgtttgggaatttaatttatctgacacatctaatgttttcgatataagtactttgtaatctgcttgagttaatcctaaagaatcataaaatgatttatattcatcatatggttttggtatataattataatcatatatttcagatcttaattcattaaattcattatattctttatagtcttttctatttgtatgatacgcattatctataaacacaacagataatccaattaatgctataataaaaattggtactaattttgatattaattttttgtttttaatacttttaatagctataatatatacaattaatggaatagtcattaaaaatattttttcacgatagctatatgaaaaaacacaagataaagtgaaaacaaatccatgaaacctataaaaatatacgttgctaataatactattttcattagcataatttttaatttcccaactatcaattatatttaaaagtgaaataattgcacaaaatccccaaaaagctgaaactatagtgaattgaacctctcgtaaatgtttttgtataataaatataaagaaaataatatataaaattgatgtaaaagtatatgcatatttagttctacacaaactaattaaagtccataaaaaatacgtagaagttatatacattgaaaaaagcattgatactccataccatggaatattatttttaaatgaatacaatgcacataaaattctactaataaacgttttaataaaaacagtattgatagatggagttcctgtatagcccccatttacaataagtcgcatcctataatcatcattagtagcgaagtacatatcaaagtaattatatataattaaaaaaaggattaaattaatcaatatacatgctaaaattattattacccttttcttatttatcggcttattaaaccatttattactaaattttccgttgcgcttgttttcttcgctattttgcattttttttatcttatataaaaatctatcaataaagtggttgaatttttttaaattcctattacttccgttcattaatttaaaaagcacctccattcgtgaatttatttactttttataatttttttaacaacaaattgtggttcatctgtaataaccataaacattcttccaatatattctcctataattcctaaaaaagctaaaataattgaagccaaaaaaaacatagtatttattaatatataaaaactaaagtccaaattggtttttttaagaaataaaagaaaaagaataaaatataaaatacatgatattaataaaagtaaaggtcctattattaaagttaaacgaattggaaaatatgaataatttaaacaactagcccataaccgtattagtttttttaatgtatagttggagctaccgtatttacgtgaaaaatgttcaatttctacatttgttatatttttagttgttcgtaaaaataatccttgaagatttgtaaaactactctttcctttaattatttcatcttttacaaatttttttgcaatccaaaaactagatgcctctaatcctttaggctttcctattaactttctaactgtaaaatcgttaaatactcttccaaaatttctaaaagtggattgcttcattttctcataacttccatatacaacatcgtagccttcattcactttcattattaattttccaatttgtgagggatgtgtttgtaaatcatcatctaaacttataatataatctccacttgctttagacattcccgccaacaatgcattatgctgccctgtatttttagccaaatcaattccaatcacatttgtattggattgtactatagaattaattacatcaactgtttgatcttttgaatgatcatttactaatataatttctagctctccaaacttattttcttcaaaataattctttagtaattttacaacttcaaatattgttttttctgagttataacaaggtataatacacgtataaatcatttttttccttcccttctattttcttaactactaatatactttatgttaaacttatgcattaaggtaaagactttattttaaatttacaatttcgtaaatgttaattattgttccatcatctgcaataatttgctccactagtgaagattgttttttatacttgttgtttattagtccttcaatactactgtcaaaatcccaacattctacataatacacatttttacaatttactaacccatctattgcactagtaaagccatattttttatttcttttataataatttggagattttgaattccaatttcctaatgaatccatatttaaaactttttcattctctaaacttgcactaaataatcgatcacttgctcctataaaatcaagagcattatagaaataaaaattttgggggtggttctttgcatatccttgtaaagcctctaatcgcatagataatgttttaatattattaatttgctcatatatgttatctcgcgcgatataataagttcctgataaatataaagctccaatcgcactgcacattatagttaataatattttttttttctcctttggaattacaatctttaaattaatcttacatgaggcaatataaaatagtataggcattattactaaaattatagcttctattattctgtccattatcctacctctaaaaatcaatataaaaacaccaaataatatatatccaatactacctaaaaaataaaatatatctttttcatttttatctttcattatatttattcctgctaatgcaaataaaaaggctactaatgctatctgtggaaaaatattatctgatatcaagcatttaaatgtattaatcaatgattggcgaactcttaagtatatagtctgttcgttaatgctcttactatattcagctactttattataattttcggtatttagtgaatcgtctacgtctaatgttctcgtttgaagtgcattaactatatcagcattcatgccaatagaatcgtaaaattctttatgtaattcataatcaggtgctggataatagtcataaataagagatcttgattttgtataatttttaaattcgatataatcactattagataatgtgattatatcaactacttggacagttaaacacaagaaaattatacaagcacttaatttaaaaacaaatttcaatattgatttatctataagtacgttgacaattaaaataaacacctccattacaagtaccataaaaaatatttcatctctaattccaaaacaaagtaaattaaatacacaaaataaaaatatcgttccatatttttttttaaagttattggcttctaataaattaattaaactgcatacagcccctaaaccacaaaaagctgaaataatagtaaattgaggtaacattatatgcttatataaaatgaaaatatagaataaaaaatatataaaaaaatttattaatttaataattacttttttttgttttattaaagtatataataaatacgtcgtaggaagatacatgcatagtaatgtataaaaatcataccactgtatagtttgatttatttcatataaaaattgcaatacataacctataaaggctttaataaaaactaattgataacttggatctccagtatatgcgccagatgaaatcaatctgagtctataatcatcattagttatataatatgaagtgcctttagataatgcatatagaaataaaatagcattgattattatagccaaaaaaatggtgaagtattcttttttatttgatttaattttgttagtaatatacatataactctcctatttttattacagattaaatacaaaaatacctagtaaaatcaaaataattccaaatatcttattttttgataacttctcatggaatataactactccaaaaaataaaacaaatacataggttaaagaattaataatgggtcctagtttatattcaatgtttctatatgctataatgtttaaaaacattgtaataaccaataaagaataaccaacgattacttgaatatttaaaaattcatttaatatacttgtatgcttctttttggcactatatttcaaaaaacattgggatattccagctaataatgcagaaaaaaccattaatgctatagacaaattacgaatcatatgaaatcaccaccactccaattataattacaattatgcctaccatattctgtatatttatactttctttaaacaaaattgaagaccagataattgaccaaaataaagttaagcctttattcgcatatgcgattgataaatcgattttcttaagagaaaattgccaaataattgcatatatacctaaagttatgaacataaatataacgcaagtaataaataaaaaagaaaagaatccttcttcatttattattgatgaacttattttagaaaagacactaacaattgaatatataaaaacagctaattgtagtaaaattaatgtcttaatcttatttactttcattttctaactcttttcttatatcaataaccgcttcctcaattgtaaatttaggttcaaatcctaatatcgtatttgctttctctgttgacattaaataattctttttatcttctggcaattctggtttcaaaatataatttccttcattattaaatactctataaattaatgatgctaaatctactatagaaatactatcttttacaccaatattaaatattccatctacttctttatctttacatgcttttaggattgcatttattacatctttcacatatattaattgtttttttccacagcccgttccatagattattgaagttttctttgtatatgcattgtctattaacgtatttattaaataccctttaacttcacctaatcctaatacttgtgctaatcttaaacttttaaattttgtgccatattttttattcataaacaaaatcaagttatccactgctgctttagcttcaccatataaattaagcgcgatgtttttttcagattctttccatgggagattattatctgaataaacagatctcgaggacataaaaactgcattttttaaacctactgataaacaagcttccattacattagtcgcaattttaatatttgcagtatattcattaaatccaaactcttttaaaggtctaatcgctgctaaacaaacaacagcatctttttcaataaatagcttgcataaatcttctatgttactatctgattgaacaaaactaacatgttcattatttaagtaactatctacattttttggcggatataaatctatacaggttacttcatgtccttcttgaacgcattcttttacaagcattctgccgataaagccagagctaccaacaattgctatcttcatagatattctccaatttcatatccacatttttccatatatccattcattttctttaccacttctccatttttataataccatctatgataatcagaccaagatatattaaaattatctcttgatacattacttccagttggttgacacataaattcaagtaccacactttctttttttggatttatttcaattataccttgtttatctaattcacctaaaagatgtttaatagacatatccaataaattaacgttacaataatacttaattagtttccacatatgacatccatctaaacgtggtgtgacttctactaatataggttcgcttccattttttattttaatttgaaaatatgcaggtccatcatcaattgataatttattcaatacccgttcaactaaattttctatttttttctttacttcgcctattccatatttagaaggaatgacatgtttatgaattattcctccaggaaattcattccatacgatacgatcagagataatattaaatataatttttccatttacagaaaaagtattaactgatatttcatctccatcaatgaattcttctattattactttaccactttttgaaaaagatagagatgatgaaattttttctttaaattctctgtagttatttattttatatacccctctttgtccctgagaatcaactggtttcataataaaaggatattctagcaaaattgcatcatcttgagaagaaatcacttgaaaaggtatattaccttcaaaattctcacctaaatattgtcttaatacgtttttagtattacaaatacgtgctgtttcagaactaacgaaatgttttagacccaaatcctcagctgctttagaaacactaggcatcgctaaatcagatcctactgagtaaactatatctatattttctttattaatatactgctttattccttctatatctacaatatttattaaagcaaatctatctaaatacttttctccattatctccatggctatagctacatccatgaacttcataacctttttctttaaaatactctatagcatctatttgagcatttccaacccccaaaattaatacttttttcatttttttctcctcttttctattaaatcactttttttatagtttcaactacaaattctgcaccctcaatagtcatgtctacgtacagaggtaatcttaatattctctttcctaaatcttcagtaactggcaacatttctggtgtatatcctaatttttgtccatatggtgaagaatgcaaaggtacataacaaatataacttgaaatacccttttcttttaaagaattgattagctttgttcttgtatcctcatctggcaatacaatgcagaacatatgcgcattatgctcgataccttctggcaatactggtcttctcaataagccttccttttctaagcattctagtccgttataatatgtattccatacattcattcttttttctagaatttcatcatagcgttccatttgggctgacaaaattgctgctaataaatcacttggcaaaaaagaagaaccgatgtcatgccatgtatatttatctactaatccgcgtaatacatttcttcgatttgtacctttttcacggatgatttcagcacgctccatatatttatcttcattaacaacaattgcgccaccttcacccatgacataatttttggtttcgtgaaaactaaaacatccaaattcggttaatgttcctgcatatctacctttgtatgtagatcctaccgcctgagcagcatcctcaatcacgaaaagaccatggcgatttgctatttcattaatcttatccatctcacatggaaaacctgcatagtcaacagcatagattgcttttgtttttgatgttattaggtcctcaattaaattttcatcaatattaaatgtatcttctcgaatatcacaaaatacagggtttgcccctcttaatagaaatgcatttaccgtagaagaaaaagtaaaagaaggcgtaattacttcatcccctggttctaaatcaattaaaatagaagccatctctaatgcagtagtccctgaagttgtcaacagcatattatcaatatgaaatctctttttaaaatgttcatatacttctgttgtatactttccatctcctgataatatgctatttccgttcaagcaatcaactactttattaatttctaattccgtaattgatggtttattaaattttatcatttcctatccctcctgaaatatctctaaccttttgaactaattgagcttgtaaaagtatttcattatagattttttctcttacagcagtgtcatttatagcattataaaattgacatatggactttttaaaatgagagtcacagcttaattcaatagttttaacttctccactttgaattattttcaaacttggtttcaaattgtcgggggctgtaaaaatacgatccgtttgcataattcctctacttccccatatggatagcatacattggtattcacagtccattccatattctccaataaatacctcatttttactatttctaaacatataacttccatatagatctatatcaaaatcctcataagaattcatgacacatgactccaatgtaatatcttctccgagtaactttgttgcaagttttattacatatcctccagcatccaataaagcgcctccccctaattctttattgtatctaaaatcatttttatcccttctaggaaaaccaaatctagcatgatatgaatgcactttaccaatttttccattttcaatttctttctttatttctgaaatttgtgaatgatattggaacatataattttcgtgcaatacaagttttctttcttctgctaatttgaccaagtttaaactatcttgataattcgtcgttgaaggtttttcaacaaatacatgcttatcattttctaatgctttctttgcccatttatagtgtaatgcaggaggcagtggtagatagattgcatcaacttcatttgacataattaaggaagaataactctcgaagatcttcccgccataggtatctacaaaagtctttccttttttccattcattttcaattacagtgtctgcaacatctccatcccactcttcttttgatgcaattgcaacacctacatatgtgaaattctcttctttttctaatgaaggtaaaaatctacgaaatgcgatttctgatggacatataattccaattctaatttttttcattttacacctctaataatgatattaaatttctaagttgtatgtttaaacaattattaacctgaactaattgatttaaagttctatagcttacccagaaataaccttcctcttctacagcatgtatctcatttttatttatttctataataacgtttcggttttgctcatgataaaatctacctccttcttctgaaagtagtacatcatgtataatatttacattatgattcattttattcataaataaatctactatctgatcctgattattctgtattttcgatggctctaattgaacagttggtcctaattccaaagaatcaaagcagccgatttctttctttatccttactaaaaatttctttacaccatcatcattacaaataaatagtccaaataaagcaatccctgttgcctcaaataatggctggcaccatctcgttacttctcttccctcaatcataatgtcacaaaatatgactttaaaatcatgttcatgaacacatttcatttccttctctatatgtttccacgtagaaagttgatctagagaaaccaatgcatcttcttcatcatcaaacatttttgaattgtttatttgttgatatattctaggaatcatatactcatcatgcattgtaaaaatcgatttaaataaacttttatcatttgcttttgcttccattgcctttaattcattagttgaaaaactgtgattataatatggaatacaagacaatacggttcgtgtatccatattcacaatattgtcttttttcattaaacgctttatttgtcctaatgtcatccatttaaaatttggttttctaccaccatgtttttgagtaaaattactttttgttgcttgaattgtaggcgacaattgtattttattaatattcccaggttcaatttttgcctgcatcaaaaaattcaatacaccatcgatttccttacaaataattcctaaataacctatttcgttttgtaaaataacgggttgttctaatatgacatcattttctctttttctttggaatccttttaccgtgaaaaatgataaattctgatttctaatttgtccttctttttcgtcatagtaccatggactacactcgttcaaagatattttttctatctgaacctcaagatcgttatttcgttgctcaatccactcatctatttcatcatttccagtaatatttcctgttttatttagccaagattcgtagagaaggataattgtatttttcacacgattacccccttactacgcttacttcattgacatcttcttctgcaagtctcaataaatattttccataatccgttttcgcaaatttctctgccaattttaacaattgaactttatcgataaatccttttatgtatgcaatttcttctatgcaggaaacatataaaccacttcttttctgaactgctccaacatactcagatgcttcaagtaaggcgttgggatttcccgtatctaaccatgcaaagcctcttccaagaactttgatatttagctttccacgacgtaaatattcattatttacagaagtaatctccagctctcctctagcagaaggtttaattgttttcgcaatttctacaacatcattgtcataaaaatacaagccaggaactgcataatgagatttaggcttttcaggtttttcttccagtgtcaacactttataatccttatcaaaagtgactacaccatattctttaggattatctacatagtacccaaaaattgttgcaccttttttggataaagcttcatttaaagttgtcgtaaaatgacgaccgtaaaaaatattatctcctaaaatcaatgcaacacgatcatttcctatgaaattttcaccaattataaatgcttcagctagtccttttggttgttcttgtatagcatattcgatacttaatcccaactgacttccatccctcaataattcttcaaacgcaactacatctcgcggtgtagaaataattagaatctctttaattccagcaagcattaatgtagataatggatagtaaatcatcggtttatcatatacaggcagtatctgttttgatacgacttgtgttaatggataaagtctagttcccgatcctccggctaaaataatccccttcatgttacactctccctttttctttatacattttattaaaataattttgatactctccagaaagaatattttgccaccactctttataatccaaataccattgaattgtttgttgtataccagtgtcaaaattatattttggtttccatcctagttctgtttctaacttatatggatcaattgcatatcttaaatcatgtccttttctatcttcaacatactttattaaagactccggcttattcaatgctttcaaaattgttttaactacttctagatttgttcgctcattatgtccaccgacattgtaaacttcacctgcttctccttttcttataattaaatcaattgccacacaatgatcatatacatgtaaccaatctcttacattttctccagtaccatatacaggaagcgattcctcagctaaagctctagaaatcattaatggaattaatttttctggaaaatgatatggtccataattattggaacatctactaatggtcactggtaaaccatatgttctatggtaagctaaaacaaacaaatccgccgctgcttttgatgaactatatggacttgatgtatgcaaaggagtttcctccgtaaaaaataaatctggtttatctaatggcaaatctccatatacttcatccgttgaaacctgatgataacgttgaatcccatatttattacatgcgtctaataaagtcgtagttcccattacattcgttctaacaaaactttctggatcctctatacttctatcaacatgcgattctgccgcaaaatttacaaccacatcaaatttctctttttcaaataaatcaaaaacaaaagctctatcggctatatcacccttatagaatttataatttgttttatcctcaacaggtttacatgtttctaaattacccgcatatgtaagtaaatcaagatttactatcacatcgtccggatatttatccaccatatagtgaataaaattcccgccaataaagcctgcgccgccagttaccaaaattttcattttcattctcctaccttattttccaaatataatatgaccctatttttttatacaaagtcatttccacatttactttataatgttcttgtataaaagtcaagatttcatttatcggtctgttctctataaaataaacattttcctttaataaatgttccatagggttatttatactatgtttttccaattgcttcatccaatccggatggaatgtatcaattcccgcaaaaaaagcagcattcttaaattctgacttttgaatccctttccatggattgtaattcaaatataacgtttgaatattggaataaaaacctaaataataaaaattatttggattctgcttaatttcgtttataacactcatatccttttctttttcaaaagaagcattatattttgctaaatcattattccatgaaataaacaatgcatcataactactttttccataacttggtatatacactggtattctacatacacttagaacgatcaaaactgcgattagaaatttatcgctaaatttttcgattcgactttcagatatttgaatgctaaagagcaaaaatgctgtggctgctaaaaagatagagtactcaacacgatagtttagtcttcctagatacatgtttaaaaacaataaacagaaagcaaagaaattcacagccaagacttgaaagattccatttcttattgcaaaaattccaatcaatgaaatgaggattagtgcccaaacacttacgtaatatttatactggcgatttattaaattgacaatcgttccttttatactcgtatattggctatctcgataggcatttaaaatagtgctaaccgtttttaatttatctaaatcgtaatattctatatctccgaaattccaatgaactaatgtataaaaatcattttcactaattccatttttttcaaattctaatcggttatcttcatatgagtagtaagaataatctacaatatcagatcgatatgcactatatgttttatatgctttaaacgcaggatatcgttgaacaaatcctatactgaaaagacttaatccaattaaaataagaaaacatgggaatattactttccctgcttttttaaccaaattcacgaaatctatgtatttgagcctcttctttattccataaaataagactggtagtccagaaaaaaataaaacaatatagatgcatttatttcttatcatatagccaacacaaaaaaggaaaatccccaaagcgacttcttttttatttatcgttttgctatctaaaatattgcttaaaataagaatgcatcctgcacatagagagatcgtcgcagtttttgtgaattgcaccaataagtatagatcattggaaaaaaacaaaagaaatatcataaaaagcaatatgcttagattatcttttttatatttcaaaaacgtatacgatataatgcataatgaagtaaatattaccgcaatttgaaaaataaaataccagttgattgttgcgataaatgtatataacatagagagaacaatcccaatcataggatgcataaacataataaatgaggaaggtgagcctgtataagctccagaaaccaccatttccatgataaagtcatcagaaacctcatacttcatacatcctgagaaagcaaataatattaggagaactaagtttatacaaaaaatcccttttttagaaattaaaaactctttcatcacaaagttcacctcctagtttttaaagctgaataacctttatatatatagtcaaccacaaactcttctttcaatagaatcaagcaaataacataacttccaaaaaacaaaattgcatatacaaataaactgaagaagactgtgaaatcggtaaacagattgatgaaaagtacaagtattgaagcaaataaacatgaaataattattttaaaaattttgaatccacacttaacttcatgtaattgttttgaagtatacataatttgtacagccaaaacagaaaattcagcaatcagtgtgcctaaagatgcaccagcggctcctaatctaggaatacatatataattgacaattaagtcaaggatagcaccaaatgtaacagagtatacaacaaatttttctttccctaaaggtgttaatatttggatacctgtgatgttagataatcctattaaaagaatagtaggagtaattatttgcattgccagcgttgcgcctataaaatctcttccagataaaacaatcagtgtttcttttgcaaataaaataaagaaaatagttagtggtaatgctattataaaaacaaatctaatactcttagaaattaaggtttgaaactgtatcttatcatttttttgaatacaataagataatctaggtaataaaaccgttcctaaagatgtgactaaacttagcaatattgtcttaatttttattgcagcattatagtacccgacctctatatcagattgcataaaaccaagcatgacagtatcgagatttgtatagactgtaattgcaacagattgagcaaagaaaaccaaaatcggtcttatatgcactagaaaactataactttcaacttttttaaaattaattaacttgcgtaatctaataaaatttaatatgttagatcctgcatttgcaaaaatcgcaattccaccataaataatataatcacttttttgatggataaagaaaaacattagtattatggatataattttaaaaaatatagagcggtaagttatatagctatattgctctagtgcttgatataaccaattaactccaaaaacatttaaaagaatagataaagaatttattagcattaaggtcttctctttatataattctggcactataaagacactaataaaataaaacattaatgctaaactagtcgcactcatatgaattataagaagctcttgtactgttttatttagtttatctttatcatcgcgtattcttgcgcatgcacgtatgccataagttggaatccctaaggcagcaatcatagaaaagtaactcgcaatagatgctgcaaatgctacttttccagttccctcagctaatagaattctagaaacatagggaaatgttacaataggaaatataaaatttgccgcagtcaaaatgaaattcattataaaattctttttgacagtttgtattttattcattaaactcttttcctaccatctctaaggcttcacttatgatatgatgcatatcataatacttgtacattcccaatcttccgccaaaaataactttattttctttatctgcaagtgctttatatttttcatacagacaattatttttttcatcattcatcgggtaatatggttcatcaccttttttccaagttgctggatactctcttgttattaccgttttttcttgcttcccatattcaaaatgcttgtgttctataattctagaatatggtatttcatattcattataatttaccacagcattaccttgataattctcgctttctaatatttctgtttcaaatctaagactacgatattctaattcgccaaagcaataatcatagtattgatcaatcatgccagtgaaaacgattttattagcaatcgtttctagttcttttcttttagaaaaataatcacaattcaatcgtatatcaattccttcaagcattttttcaataatcggtgtatatccgccaatcggtatgccttgatacaaatcattaaaataattattatcgtatgtaaatctcacgggtaatcttttaataatgaaagaaggaagctcatcacatcttcttccccattgtttttgtgtatatccttttactaatttttcgtatatgtctcttcctactaatgatatagcctgctcctctagatttttaggctctataatacctgattctttgatttgctgttcgatttttttcttcgcttgctctggggtaattactccccaaagcttattaaacgtattcatattaaaaggcatattgtaaatttcatctctataccttgcaataggagagttggtatatctattaaaagtagcaaattgctgaatatatttccagacctcgtgattagatgtatggaatatatgcgccccatattcatgaacattaataccttccacttctttagtgtaaatatttccgccgatatgaggtcttttgtcaattacaagacaattttttccccttttttttgcttcatatgcaaaaatagaaccaaatagacctgcacctactatcaaataatcatacatttaattcactcactttccatcgaacttttctccaggttcaacctgttttcctaataaattatgcctagcatcatgatatgcttttttggtatatctaattctaggcaaagaccattttgaaattgctcttaaatatgaaaacaaacaaaaatacattgggcgtaatcgtttaaaaatgaaattcttcccatatttcatatcaaatacaaatgaattcctcaacatatagtattgtttccaataaattggttcacttatattgggcaatggtagttgcctatttaattttgcattaaccataaaatatatctttgttatctttgtacagcggtatgcgtagtcactatcatcaaagagtaaaaaatatttatcatctggtagaccaatttccgacaaaatttcagaattaaacaatggtccttcaaacgcaaaatccacaacttctattttttcttttccggtaaaatctgaaataacttgtttatcttctacacgtttaaagaaattgtcaaaattcatttttataacagcattatctttaaaattttcacaagttctgtttgggatgcacactttatgattttcatccattccctcaagcaaaatttctaaacaatttacttctggtaatacatcatcatccattacccaataatagtcatagtcatactttaatcctatttcaaaggcttttttaaatccgcctgcccctccttcatttttttcatttaaataataataaaatttgatattatttaaattagtgatttgtacctcattaatcttttcatgtaagtttaagcctaaagcatttaaatgacataaagtcccatcagttgaatgattatcaacgactacaatccctgatatttgatgggtttgattacttaatgcatttaaaactttttctaaacattttttacgattatatgtacataataatacacagacttttttattcatttattcgccttccctttcttttttgaactatcctaaatatgtaggagcctactacaatttttaagacagaaatttttagttttttagataatacacttagctttatattttctactaaaacatgatatgctcctgcataatacatccttttaagttctgatctagcttcatactgcataagttctattgtatatagtaaaaaacctttcggcgatttagccaaatgattatagatatttctagttaagcctgaatccaaatactcacatcgataaatgggttcattaaaccatcttattttatatccgtctcttgctatttcattccataagacacattcacttagaaatttttcaccactaaattccggaaatctatacttctttattacatctgtataaaaaacctcagctttatctccttttatattcttttctcttctttctatcgaagaacagtctaaatattctccttcaaacgattctcctacatctccactaaattcataagatttcaagcctccaatacctgcaaacttttcttgttcactttttagagtagtaaaccaaaagataattctttctattgaattttctggtaaagtatcatctgaatcaactataaagaaaaattctcctgtcgcattttctattcccatattaactgcatgatgttttcctctatttgttgattttatataattaattccaaatggactcttttctttcagcttatgaactatatcttctgtatcatctgttgatccgtcatctactataatccattccatcatcgttaaatcaactgtttgctttgttaaagtctcatataatttaggcaagaaactagaacgattatacgtaggtgtcataattgttattttaatatcactcatattcattacctttttcaaataaacagtcaaactcatataaacgtgcttgtaaatcaaaaaaaggacttctttctactgctttttctctcaattcatttaatttatccttatccataagtaattgctttaaaccttcatatagtccattctcattattctctacaattagaccgaattcactgtctcctaaaatatctttcattcctgcacaatctgtcgtaagtacaggtgtacctaaaaaaatagcttcagaaaccactgtgctaaatccttcagttaatgaagaacatacaaataaatctgctttttttaataatggatatggattatcaataaatccagttaattcaacacaatcatttagtttattatcatcaataaatttttgataagtatccttcaagagtccggttcctacaatttttaatttaaatgtcaatttatcttcttttaatctaacacaacactttaaaagtcgatcatatcctttttgtggactaagtcttcccacagtaataagatttaatggattctgcctcttatattctgtaacattttttatagaatttagtatcttattagtatctagcacatttagttgaacttgcactttttcttcatccacatcgtatatttttaaaaaagaagttttcacatcagatgaaacgcataatatcttattgtaaaaattataacattctttcgcttcttctttacttctatagtatttattgctatcaggcagatttattaaatcaacatgaacccatgcatatttgggagtccttgacttagaaccggcaattatcttagttactggtccttctaaaaatgctatttcataatcatattctccctgaacatatttcttgtataatttttctttttttgaaaatttaatatatcttaaaaaaagaaagcgaatataatttctcaatcgctctggatacgcttctaaatcaaaagcaaaaaaatatgttgcatatttttttatttcttctatatatattccctcatttaacaaagaaaaaacatacacatcatatttcgttttatccattgctttcactgtatcaagaagtattttctctgcaccaccaccaattaaattagttatgctaaataatattttctttttcattaaaagcctcccctaaaatatccaataccagccatatgctatgatatttgcatatgtcgctaatatagaagcaattgacaaaaataacataattatagataaaatatgtgttagtttaattttaaatttcttaaattcaaaataattattaatctttttttctgataataaaataaataaaggttctatcataaacaaaggcaccaagtacataaatcttctaatcagatcaaattgatagaacgttgataacgctaatattgtatatagaattaaatacttaattgtattagactcctgtttatacattagtataattataaaagaagcaaagagagcaagaagcataaataaaatcatataattcgcattatatggctgtatagttccatttaaatatggtagtatcttaagatacacaaatgagtctttcggacataaacttaaaaaaaactttaaaataggataatgaaaaaaaatacctactaataaagcgaactgaatttttctattttttatccaatctactaataaaggaattacaagaaccaatgataccggatgaataagcgataataataaaactacaatcaagaagtgatgaactcgtattctctctgttcttaatgcataacaataatatgcaccagtgataaaacaaaaataatttcttattgctaagatataagttttataaaaagacatgcaaaatataaataacaacatacctatcaatatatttttgtttcgtatttttaaatcatcataaatcattagtattagcttaaataaatagaaatatccgacaaatgtaaaaatcgcttggtataagcctaatatattagtttgtgcaattatatacattattaagttattcaaatataccaatgaatatcctgaatgaaatattaccataatagaatgattttgataacttcgcatgacatcaaaatgtctctgtaagtcatccgatgtattaggcaatgtatagaaagcaattaaagctaagccaactgaaatcaatacaatggataaaatatcacattttttttgttcttgcctaataaaatagcatccactacctatacataaaaccggtaatataatgcaaactccaaaaagaatattagacatctataactctccttttatgtaattttttataaaccttttttggaatcattccaataattaatggtttcagtgcataaataaataagtactttgtcattcctgtacgcttcatccaataaaattttagtttcgcctcttgaattctatatacatattttcttttttttattccactttcatcttctctatattctaaaagataatcaccaataatctccaataccattctttcttctttcattttacaccataaatcataatcttcagcacgacatgttaattcagttactgtatatttattcacattaagtatcgcttcttttctcatcatcacagaaggatgaataagggaagtttgcttaaccgcttcttttaatgaaatacttttcatatgaggaaattcagtctttgaatacctatttgatgagttatctatatagtatacattagtaccaatcacactagtttctggatgctcatttaaatactctacttgaatagaaaatctatctgataaagccctatcatcactatccattcttgcaatataatcacctttagatatatctatgcacctattaagtgaggctgctagccccatgttttttttattatttataattgttattctattatcaatttttttatatttctctaatatcttagtgctttgatccgcagaacaatcattacatataataaattcaaaattcttataggtttgacaaagaatagattctattgcttcttttaaaaatctctgatcattatacacacccataattacagaaatcaaaggttctttattcatttctctcataaatttccctcattttcaaattcactttctttatagaataatttgaaactttattataattaaaagcagccattgatctagaaaggtctaactctaatattttatttatataaatattaaatttttcgttttctaaatccacacagtatccacctttctcattctcaattaaatcttcatttcctctaattttggaaacgacacaaggtaatccacatgccattgcctccattaaagctactgacagtccttccctttttgaaggaaatacaaaaatatcgcatgacttcattatcttaattacatcttttctatatccaagaaaatgtaatctgtctgatacatgtaatttcttggctaatcgctcatgttgctctttcaactgaccatcaccgcacattagataatgcacattattgggtaactctggtaatatttctattacaatcttgtgatttttattagcattaagctctccaactgaaagtattaagattgcatcctttggaatattcaactcttcacataattgtatcttattttctttaattaaattaattttatctatatcaattccaacacctggtacatattcaacagtaccgcttttctttaatttaaatttctttgctgcaatatagtcttcattgttaattgtaatcagtacattcgtatattttgcagcaattttttcaatatttctaaaaacaaaatttttaaatggattgtttcctttaaaaaagtgaaaaccatgcgctgtgtaaatcattttgcaagttccgtatatattactttttttataagctaaacgtgttataaagcttgagataggtgtatgtgtatgaactagagaataattcttatcatttaataactgctttatttgtttataagaatttattatgttttttatatttttaggacttctcgaaaaactaatattaatttttttaatctttaattcctttaattcactttcgaatttttttattctttcttcattccaaactgaataatcatcaaaattgcaggcaacatctatcgtatatcccagttcttgtagtaatttgatattattcatgttaaactgtccaatcattgatggaacagttgcagtcattaatactcttttcatactttctccaatcttatttcatttgttttgctggtactcctatataagtgccattttcaactatgtcttttacaacaacagaaccagcacctatcaccgtctctttaactatttcttttccttgtatgattttagttcccgttccaatttcgacacaatcatttattcttacattccctgaaatattcactcccggatagactgttatatagtcatgaaactgcacatcgtgccctaccgtacaattcaaattgatatgattaaaatttcctatttctagatttgtagttagaatactacctttacaaataatatttccaaaacctatcgtgacagttttatctataatgacatctttatcaaatatattaggaaatgaaatattcttattaatttgaagcctttcaactattttttttctgattcgaggatttccaatggctactactacattggttttctcatttacattaagcaaaaaatctattgtgcctaaaacaggataatcattcacacttttatgttctaaatcttcattatcatctacaaaacctttaacattccatttatctgaattttcaattagccatgctacttctctgccaaatccagatgcacctacaattacaatattgttcatttcatcacctattaatcatcctttaaactcctccattgtcgaagaggtatcgctactaattccttctttcttaaaaaccgttttcacagtcataaataatatcttcatatccaataaaaaagaatactctttcgtgtattctacatctttttcaaatttctcttcccaagaaattgcattgcgtccactcacttgcgcaagtccagttaaacctggtcttacatcatgtctttgtttttgaaatccattataaagtggtaagtaatggaccaatagaggtctaggaccgataatactcatatctccttttaaaatattaaagagctctggaagttcatcaagtgacgttgaacgaagtttctttccaaatgaagttaacctaacttcatctggcagaagatttccctccccatcagtttcactcgtcatgcttcgaaacttgtacatcttgaatatcttttcatccttgcctggtcttttctgtttgaatataacaggacttcccaatttcactcttacaagtatggctacaatcaagtatattggactcaacaagattattgctattaaggacaatgtgaaatcaagaaatctcttaaaaaataatctgtacattatttaaagcaccccttaatgatttctatgatttggccttgctcttctattgtcatcttattatcagaaggtagacataatcctctatcaaaaatatccatacctgcatctaatgtactgccttcgagatacgcattcgttcttgctcttccgattccttctcttgtaatgaaaggattcattctaaacactggctgcatgtgcatcggtttccaaattggtctgccttctgcattgtattttgtcaattcttctaatatctctgttggacaagttttgcctgcttcactaataaatagtgcctcttgttcacttcttacctgtttacacattgcttccttatcgataattaaacaagataaccagaagtttggctcactattctcttcatcataaggattcatttttactggcaggtcttttaacccttttctatatctttcataaatagcctttttctgtgcgatatgctcctctaagtgtggaatttgtcctcttaccacacctgcaatgacgtttgacatccggtaattgtatcccaattcttcatgctgataccaaggtgcattttctcttgattgtgtagaccattttctaactttctcagtcgcttctttatcgtcagtcagaaacatcccacctgaggatccagttatgatcttattgccattaaatgatattgcattgtaattcccaaatgttcctgtctgtacacctttatatcttgctcctaaagactcggctgcatcttctatgataatgacattatgctttttacaaactgctttgatttcatcgattttacctggggttccatataggtggaccaagacaacaatttttacctccggatataattcaaacgctttctctaaagcaatcggatccatattccatgtatcatattccgtatctataaatactggtatcccaccttcatagactactggattgacagtagcaccaaatgtcatatctgtacaaaacactttatctccaggttttactccagctagtttaactgccatatgtaaagaggatgtcccagatgctaaagcaacagcatatttgcatcctactttttcgcaaatcattctttctatttcattaatgtttttacccactgtagacatccaatttgttttataggcttctgtaatatattttaattcttctccatgcatagtggggcttgacagccatattttatccttgaatttctccaaatctatccctccaaaataaaagcaagtcccttttcagcacttgcttatgatctctaatccgacttttgttgtggtttctttgttgaacatgctgagttgaagataggcgacccgcttatgccgatctattcttatgatttgtccttctttcccctgcaatggtccttctgttataaatatttgctctccctgtatgaagcctgtagacatctctacaacatgattttcttttccaaatgatttcatgaaagcaacttcctcttcatttaaaggaaatatatctgcttttttcttaccgatgaccttcacgaaatcaggtatttttttaagctctatatttaattgatcaatctgatccgttatcatgaagatataacctttgaacaggatatcctttacatcatgccagttccccatatatttcttttttcggatatactctggtataaagcaatcctgtaaaacatcctttgaaatcatagtccggcatttctctacgatctttctttcgtgaccgcttctgacctgtccaacataccatttcatgctgttacctccaatagggtaggcttcacccatcaaacttcttttcaggtttgactttataacatctatgaccatacattcgtgatgaacgtgacatagcaacgatccatccctaagcattattttcaactttgaataactgtctattatcctttgttaaaatgaatttagcactttgcattttaactagaaacataatactacaaaagtaactatattgcaaccattcttaattcatttcagctctgaatgacaaacttattttatgaattcacacgataatctgatgatgattggcagattttgaaaaaaaagatatatcaacaaaacgtgatatacctttgctattatttcataaaaacgctttgatcctgatctgttatgattaagctcagcaacctgtttttaatatcattacgatgctcgacatcatttaatatttcttcaagtttgaccaacctgtctgtaatatcttctttggttattgccatgacattgtttttaaatatcaaattattttttgttcttgttgttgtttctccatcaagctttaattcctcaaacatcttctctccaggacgtaacccaatttcaataatatcaatatccttataaggtttgaaacctgacaatcgaatcattttttcagctaaatccaaaattttcactggttctcccatatcaagaacaaagatttcgcctttatctgcatagaaaccagcctgcaatacaagctgcgctgcttcaggaattgtcataaagtaacgtatgatatttttatctgttatcgtgacaggaccgccttccgtaatctgctgcttaaaaattgggattacggaaccattcgatcccaaaacatttccgaaccgaacggcagccatcttagtcacgccattatcaccatttgcttgcaaaatcatttctgtcattcgttttgttgctcccatgacattggttggattaactgccttatccgtactaatcataatgaatctagatacgttattcttaatacatgcattaatcacattatttgttccgaatacattgttcttgatagcttccataggacgcgtttccattaacggaacatgtttgtgtgcagctgcatgaaagacaacatccggattatattccttaaatataccattgattgctttaaactctcttattgatgcaattaatgaaataatttcaattgttttattcaatattccatgtgtgcgatttctattaaattcctgttcaagcatatataaagaattctcattaatatcaatcatcatcagctgcttcggtttaaacttcacaatttgtcggcataactcagatcctatggatccaccggctcccgttactacaacaaccttatctgttaagtaacttttgatttcgttttgttctagctttatttcaccccgaccaagtaaatcctcaatgcttatatcctgaaccggatactttttaggtgaatttaactcattgacaagtaaattgtctccttctttcataattttcgtttccagctttgcagactgacacaggtcataaattcttctcactgtatccttatcagcactcggcatagcaataaatgcaattttcacatcatacttctgcacaatctctggaatatcatatgtatctcccaaaaccctatatcctgatatttcattattgattttcttatcatcaacaaagcctatgatactgacattgaaattatcattttgcgccaattcctttactagaacataaccggcatcaccagctccaataatgatagctttctcagttttattcgtaaccttatatgtcattcttctatacaatctataacaaactcgtacattaaacatcaacaaagctgttaagagtcccccagtaactataacactaagaaaagttctatctaattcaaatatgatcgccaaagcaaacaatacgacagtagataaaacaacagccaaaccaattctcaaagtttcaataggcccgacatacttccataagcttttgtgaattttaaacaacataaagcaactcatgtatattaataaaactgaaagcattgccagcgcaaagtcccttatatagattttttcaaaatttggtattctaaattctattttaatccaataagccaatagaaacgatacaaatacgatgcataaatcaaaaaaacacagcatcatctctctatgattcttatatagactgttgttaaatattttctcaatcattacagccactccttcatacctatcctattctaccatacaactaaatttaataaaatctaattttaaaaaacaagagtaaatataccttatatttaacttatatatcaataatgaaatgttatttataccagaatttatggattttcaagtatctcatatctaccatataagaaaaaatgatttacatcctaaagaatagctttcaactttttctaatatcatgatgaccgttagcttttccacaaatataacgaatatctccttatagaggattatttcattttcagacagctttatccattacagatagaagtaccatgcaagtgtattacaaagcctttagagaattatctattaatgctgcataactcaacatcatgcaccaaatttcactcgttgctcacataagtcttaattcttaaaagatccaccattatcttcgaacatacaaaaaagaaatatttaaattatcgtatatgattagatcttgtgtcattgcgatatgtgtcttatagccaaagaaggttgtatctgttatcttatgaccaacctttgcgtcttgatcccttaatactctatctctatctgtgtatctgctactccttctttcagataattattttgttcccttaacgtttcaattacttccatccttgaatccgcatcaattacttcgctcagttcattgcagtattctatttcgtcttccaataagccactagattcacgcttcttcggcattttttctttctcatccggagcgaccgcatatactgctttatgcagttctcttgctctttttatcaattcttctctaggtgagatatgttgatacttgcattggtatgtgtagaatccagtatcagatttaccttggcttccataactccagccttcagagcaatatctatggttgttgaaatcaatacttctaatagatttgcatcctttagtcgcatatggcggaacttagacaatgaactgggatttataaaattaacttcttctggattatatcctagaaaatatttgtaaagcatatccgttcttgtatgtacgatcaaatcccgatcagacaacttaaatttagattttagtaaaatatatttaaacatgacgattggattttctgcaggtcttcccatacaatcactatatttttccttcacttcatcatatataaatccaaaatcaaccatctcattcagtactctccagaaatcatctttttcaatcaatatatcaaacaattcgctatatgggcttaaagtcatactctcttgttctacttttcctaacatcatactcaccttttttttgcacctatattataccattctaatgcctatgttcgcgtatttacatatataaaaagagaactgatttttacatcaatcttcttaagactttttcagcaacctccctaattcacaagcttctctattgatatgtctatttatctatgaaactaacgctttgaaatcatcccttacttttttgtcatagtcttgaatattgtgtattatttcaacagaatatttttcttcatcacgattaaagataaactctattatttttgttggaataaccaataatacagtaatcaaggatactgaagcactgatgaaaactactaaagtagtcacatcaaatcctctatttaccatgactgcaattgagatacaatgtgcaagtgccacaactatcagaatacctaaaaaaatgattacagaaattttcttactcctagttttgaatgaaaatgattttgtaaaataatccctatattctacaaatatcgtatattcttcatttctttctttgatattcttttcttctattaaattcgtagggatcaacttcattattccgcaaatcttaagttttttagtaaattccaaatcgtcttttcatttgattcttcctctaaccccaattctctgattctttttaaaataaaagtttcagaaacatcaaaaatatccgatagttcattaacaatcgcttcttttttatatcctaaaagtgaaaaagtctatatttgtcagtaaaaatatcttttggcattaacaaagccgtagcaaatctatttactcttatttccgtttcactagtaagcctttccttatccaaactatattcatccgcaaaatctgacttcccatcatactcaaatatgtaatgtccaaattcatgagccattgtaaaacgctggtgtccacgattttcatatgcattaattaacatgattcttttacaccctcgtgcctctatttaggaatcacttacaccaataaatccagaaatattcgctgataggttttctttatatatcttaaacccaactttatcaagaatatgcgcaattggtatctgataatccaacaattcaaattgatggcgtacttcgcctgcaaacctttcaatttcgttcgaatcagaaaaatatttaaaataattgttttcttgccttaatttatcagatacacatatagctctgcactttcttttctttctcaatgtttaacacctcaaacttattttataaattttttcttacttttgtaaaaataagttatagatacatggtctttaacaaagcccattcaccccttccctatccatgaaggataatataggattatctttataaggtgagagatgaaatatttaactgattggaatgcatttaaagaaaatggaagttttaatggaaatttatttgaagatctcgttaaagagcttcttgcatgtatgtatcccaacgtcatatgggaacaaacaaaaaaatcctgggatggtaataaagattttgtatcaaaaggtcttcattctaatgaaaaatgggcagaatgtaaatgttacaaaaagaaattagatttaaaagtgctggcacctactttagttatgagtactgtaagcaatatcaaagatattttaattttctcttatagtgagattaacacaaatgcaaaaaggaaaatagcacaatttgctgaaagtcaggaagcaacaattatagtatatgagaatgaagtcttagaagagttaattctaaagtatcaagatgttttaaatatcgaaatatattttccttccttcaaaaaatgtacatatacagatttagccttacaaaatcagctttcttttttaaatagtaggattatgaaagagcaaagctggagagagttaaaaaaggaacgattaaggataaatgacattataaaaataacagttactgtatgtaactcatcattaaaaagtgttgattgctcgcttgagataaaaaaatatgaaaaaaacatggcgatgcttactccttcaaagatcgatagtgtacttaaaggtggagagatcaagtgttattattttcatatgcagatcaatcattatgataatttgattaaaatgcctgaagtatatcttaataaaatcaaaattctatctgcattttctataacatgtgattggctattagagaaaccactcatcggttgtataaatgaatgcgagaaaatcaagaatgtcttaaacagttcacaaaataacaatccacatacctttttaataacacctgatttagatgcttcgttatgtaattggataaaattatatatgtctttttgactatctttttatatcttcttaaatgtccgcaaagccttattttataggctctacgggcattttgcttttgtggtaaacctcacatatctaggtctatcttcttatattttcactatcaagcgtggttaaaatcgtggtaaatacttctatgcaattagacgctgaacctctgattttgcggtatctatggacgcatgagcataccagttcattgtgatactgatatttgaatgccccatgatatactgtaaatcttttgggttcatgttcttgcttgccagtcttgtgcagaatgtatggcgtagcgtatgcggtgtgatatgtggcaagagcctgtccttgtggtgcttgttgtatttctttaccatacggacaaatagcgttgtgtaatcaatcgccacctttggcttgcctttggaattgataaacaagaaatctttgtgtccgtctatctccattgaccttatctttgagcgtttcttaatcactctgtgaaatgcttgtatcgtttccttgctcaatggcacgttccttactccgcttttggtcttaggtgtttcaatgtaatagccttgttccttgcttttcaatagctggtggtctattactacaacctcattcgcaaaatcaatgtccgccattgtcagcccacataattcagaaatgcgaagtcccgttttcaacagtatcagcacatcatcataatacttatgatacacattgtctgtcttgatgaatgacagtaaggcttgttcctgttcctctgtcaatgcgactttctctttcgtatcattttctaggacttcacttaacttgaaatcaaaagggttcttcctcacacaatcgtcctgtatggcgatatagaatgacgcttttaacgagcgtttatggttgttaatggtattgtaggaaaagcctttgtctttcatgcgtaacgcccattccttagcgtcagagggtttgattgtatcaatgctcctagcacctaacttgtcctctttcaataaccgcatgagttgttcccgttgtttctgtgtgcttttcttcacatttgccctctgtgcgttctgtttggcatagagttggcaaagcgtcattttcttgccagtgctgtcgataccgtcctcaatatcccgtcttatctgctgttccagttctcgaagtgagggtttttcccgttttccctttggtgtcgggtctgtgggtgtcaatctccaagcatacacatattttgtgtttccaaatgcgtctacatatttatataagtattttccgtctgttcgttggctctctccagtatgcaggatacgacctttgttatcccgtcttttttctttcatggtgtctgctcctttccttgttggaaagagccttgatatgacttgtattcatcataacacatacaaggctcatttgcattagatagcgtccaatttatcaatgacctgttcaaactgtcggcgtttaatctgtatgcggttgccattcataatgagccagccagcgtccttgttttcctctgccaatcgtcttaacttgttttctccgatacggaaatactttgacgcttcttcaatggtaagggtgtatttttcccatacgggaatatcctgtgcattactcataaaacaccccctcactttcgattacgtctgctatatccgtacacatctgttccacaatcatttcctgcttttcggaaaggtgggtacattcatcaatcattttcatgtagtttgagcctgtcagcctgtcgatttcctcaatcatcacaatagacggcatgacctgtctttccagccattgcagagtgcgttccatattgacaggtacagggttcatttcaaaaggtgaactgtcatgggcaatgaatatctcccacaacggatagtcgggaaattccacaaaatcagtaatgaggtaaaacaccagcccatgagggttatacgtcaataacagttcctcaactgcctgtactgcctttttatcacgcaggcgaatttcaaaacggttgataatatcggtatgtttctttttcgttgcctgttcctcttgtttttcatacaggcagaagtattttgtgcttgcctttgaaccgatataaagggtacttgctaaattacggttttttccgcttagttttccaccctgcacattttcataatttttacagcgacaatccgcaccgccatttctgtatttttcagacaaaacgggaatatccaacagaccacacatatcattgattgccaagtcaaaacgtcggataacaccgccacagtcaagacagcggtttaaaaatgaataccaatctctgttctgtgcctgcaagacatattccatgttgcgtgagcctgccccttttaattccaagaatacgcccatgtgttcgtcatcagaagccatgaccttgatttctccgtaggcgtaatgctctttatagccataatacccatagtcataatggataaaataatctgctttcatgccaagcacctttcggataatttccaatgcgtcagtcgttggaaaacggacagacagataatcaacgagcagataaaaaggcttatcgcagatataataattcagacaacgcaggataatattttgtgtttccttgctggcgttggcttttccgttctcaaagcggttgatactatatcttgatacatgggtaagacttgcaagttctccttgtgaaagaccgcttgcaagacgtttgttcttcatttcaagtgcaaattctaaattgttcattgtattcctccaatcccacaatagccttgaaatacctgtaaacctctattcaaaaagtgtgatatgcactatcttcttaaaacttctcattactactcacaactttgggattgtatggtttttgacttgtcttttgtgaaatagtgcccccctgttagataacgggggcatattcaaggctcgcaggttcgccagcagacaaagcatttccgtcctttgacggcagagccgtcatggcgttgttgctggcgcacgccagcagtcctgcaatgctttgtctgcaaaccctgtttttccttttctaaccatgccatatcaaccgatattcatatctacgggtttaatcagataggatttactttttaaatggttttatatttcattctgttgtgcttaatcatttgcaaacgcatgataattcttgtatgcttatttgtcaatatctttttttgtctttacaaaccatattaagcatgatagacttataacggaaacgaaataagaagatatacagagttacggagggttatgcagtgaaaataaattttttgggaaacaacatacagaccatcagaaaatacagaggaatgaaacagcaggagcttgcggacaaaatcggtatcaatatgcagagcctttccaagattgaaagagggttgaattatcctgcctatgatacgttggaaaagataatggaagtgttggacgtaacaccaaatgaactgttgtcgggggaatggaaatatatcaatcaggctgaaaaggaagtctgtcagtttctaagagctgaagaactcctaaatacagaactgaaacacgggcattatgacaacttttttgacagtgaggaagaatggctggaatatgagttagaaaagttacgggaatatattaccgactacatcaacggaaataacatacaggcagacgacctttacccaatcaaagaatttatccagcatttgaagtttcaaagattgttagaccgatatgacgatttatacagcatggatatgtttggggaaagcatagagggacataagtataaaacaccttttcaattcgtgaaacggataaatcccaactcaaaagaagatatagaactgttacgggaagtattaaggaataaccattttgatgatgaggacgagtaatctttttcctcttgtgagaagatacagcaaacaaaaagcccgatcaagagtgcaaagcaccaccaatggtggcaagctcttgacagggctttttcttttctgtgctggttaatcaagagaaagaaagggataaaatgtgatttatggtaaatcagacgaaggcaatgcaggtatcgcagtttgagcttgtgctacataaggatagtaactggaagattgtagaatagatttttaacagcgtgcattttttgtaagtctgcacgctgtcctttgcctttcattcatcttttagagtaataccttgattataatcttctttgtggataatagacaaaggaggaatttaatatggcgaaatacgcatatatccgagtttcaagcaaagaccagaatatcgcaaggcaggtggaagccatgcaggaagttggactgacaaagaaacagatgtatattgataaacaatcaggaaaggattttatacgcaagaattatcaaaggctgataagaaagctgaaagcaggcgatgagctttacattaagtccatagaccgtctgggacgtgattatgatgaaatactagaacaatggcgttatctaacaagagtaaaagacattgatatgattgtactggattttcctttgcttgataccagaaatcaagtgaatggcgttacaggaaaatttatagcagatttggtattgcagatactttcctatgtagcgcagatagaaagagaaaacacaaaacaaagacaggcagaaggaatacgtatcgcaaaggaaaaaggtgtgcaatttggacgaccaaaacatgattttccagagcaattcgaagaaatttaccaactgtgggaaattggagaaattagtatgcgcgagggtggacgtcgactaaacactcaccacactacgtttgcgaggtggatagtccgttaccaacatgaaaaggcataaaaagtagactttttggaccaaaatgcagactttctacaccacttctaaactttgtttttttgtactgatttaagtgtaaaacagctatttttatccaaaactatcctatactaaatgataacacacacggcacaaaaagtctgctttttgtgccatgcacacttctgacattttaatccttttatcctaatgtgaatatcctaaactacattgaaaagggggggagaaaacgagataacggcaaaacaagaatttctcataatgagaaatcggaagtgcaagccagagaaacaccagctcatggaagtacaggatttgtcctatctggtttaaaacttccataaatatgaaaaatcaaaaaggagagaaataagatgaagcaaaaattaaaacgcatacttgcctgcgttcttgttttatgtatgggctttggtgtacagtctaatcttgctttcgcacaggaaaatgtagcttataatacagaagatatatcagatgaagctgatacaatgacagacggtactaaagatacagacacaacgagcaaagatgatttgaacacaaaaacagaagagaatgtaggcgatagccaacattctaaatatggattgaccgatagagaagtatgggaggaatgtaatcagtgttcaaaagataatccacatttgatttctactacagcagaattagataaagttcgtacacatacccatacagaaggaaatgtgactacaattacaggttatttcaaattagtaaacgatatcgttttcacagatgaagattatcaagaaaatggtgctttctataacaatggctggggatggactccaataggccataacaataaaacttcttattttagtggtgaccaatttcaaggggactttaatggtgatgattatgctgtaaaaaatataaaaatagaacgacctgctggctattggtataatggtttatttgctgcaccaggagataatgctcatatctataatcttaaattagaaggctttacaattcatgcagatggggcaggagctttgtatggacaatcgtacgcaacaaaaaaagacagtatgttggttgaaaatatcacagtagataatagttgtataacaggaattagctcagctgctaaatactcgggaatatttgcagcgtgtattaaagggatgcatagaaatatcactattagtaattctacgtacaagagcgaaagaggtgcttggaaaggtgggtttattgctagtgaaatattaacaggtatgcttgaaaatgtaacagtcactgactgtgaaatgacaccatttgcttatacaggaatgttgatgcctggcattggaatggatacagtaataaaagatgttgttatcaaagacagtaccgtaaatattactcatcacgcttggagttatttgatttttgaggattatcgctctaattcaattggtctcacacctgtaatatcagatgttaagatagatgttaacatacagggaactactgcaaatttaaaaggtgcaaagacaactataccaaagttgaaaaatacagatgtctctcctattcaaatggacaatatagatgttcatgaggttttaacagataaaaccacaaattctcaaagtaaagtagatttcagtgtagatactaatgttattagtataccaagtgatgcagaaaaaaatattaaagctgaagagagatatatagtgagtctaaatggtggacatatccgaccagagacagtaaatgaagaaggtaaactcatagcagacagaagtggatatgcctttgatggatggtatgaaaataaagaattgaacggagattcaatagaaaaattgaactacaatacgtactactacgcaaagtggattgaactgaaagaccaaagcatttccatggaatatggctctactaaggaacttccgacagtttcaggagttacgctttccgaatggacttccgcagatgaatctgttgcgaaagtcaaaaacggagaaataaaaactgtcaatgcaggtaaaaccaccttaacagctaaagcgagcacggcaagcggtggcacagcaactttcacggtcaatgtagaagtaactcctatgagaattatctatggttcaccagatgaaacagaagacggtcgaccatatattgtatattcattaaatgaagacggaacagcgcctaaaatcagtgatattttaggattctatccggtaaaagagaaacaaggagaatccggttatgaagcagatacttctaagccaaagattacgcttaaccctggtatgggagcagacggcgatgtggaatatacctatgtaaatgatgttagtaataacaaaattactactgatactttaccaattcatccaactgttgatgaaaatggaaatcctcatagtattcgtgtagaaatgaaactaaagaatccaaactatcgtttcactacaatagggacaaattggcaacaaggagatacaatcacattatttgttgcttgttatgaagaaggaatgaacgaagtagacatgtatcttgaaggggaaagtgaaccattaaaaatctttgaagaacaggtttatgaatatacaggacaaggagtagtgcctaccacaaaagacttgacaactttatatacaaaaggaaagaatacaagtaacacgattacaaaattcacggttcatttccatgcagtagctgaagatacaaagtttgccggttcatacatagaacaagttacaaatgaccaactaacaaaagaggctttagaaaaaattgcacctagagaattaggagtatattcatttgtgataaatggttacaacaaagatacaaagacttatagctatgtatcacgccgttatagtattgttaagggtaaaccgacaggaaatcctgtatttgatgtcattgaaagcggaaaatccttattggaagttcaactgagcggaacaatgaaaaataagattggagaaaccgttgcaggaacattcacatgggaagatggaaatcaaacagtagaatcaggaaaagcatataaatggacatttacaccagatgataccaatcattatgaggttgttaatggggaaagtatagtatgcccgattcctatggaagaattaaacgcaattccaacaatcaatgcaagtgataagacattgacagttggcgatacattcaatccattagatggtgttaccgcttcggataaagaggatggcgatattacagaaaaagtggaagtattaagcaatgatgtagatacttcaaaagcaggaacatatacagtaatatacaaagttacagatagtaaaggagcttcttctacaaaaacaatcactgttactgtcaagggaaaagacacacaaaagccaacaatagatgataacaagaaaccgtctgcaacggatacggataagaaaccagcaagtacagataaacagacaacgtctaacagccctaaaactggtgacagcacgaatatgacaacatggcttgcgctcatgttcgtatctcttggtctgctggctggcgtattcacagtaaggaaatcacgcaaaagcagataaagactgcggggaattttatggacagagatatttttgaggacatgaagattgaaacggagtgttcttatatttcagatttaccctacatcaagaatacagtagaaaagaaactatttgaacttccgtttgacctctattccaaagaacagcttcaagaattttgtgactatgtttttcgtgataacggagctgtctatcagtctcttatgatgaaatatcgcaggaacagcagatataattaggcttgcaggaaaagatatacaataaaatatcactttaattagctcgtacagactatatgttttgtacgggctttttatatacctcttttctgcattttcagaagttataaacaaatattttcgctatgaaatattccgtttgtatagtttagctcttgcagaaaggaggtgagattatgggaacctcttcttccgagcatatcgtcagattacaatttaatgctttgatgatgattgtcattaaaggtgcattatcaagtcatagaagacagattgctaggcgttcaaaacatgaaatactattttgtgaattgcctgaaatgaagcaaattgaatatggtatgagtgatgaatattcttgtgattatgtatcgtttcaagttatgcattttgtaatttatgtagctgatgaagaattaagtacagcgttgaaagaattaacagagaaacagcgtaatgctatcttgttgtatttctttcaaggcatgaacgacagagaaatctcaaaattgtatcatgtatcacgttcagctatcaatagcagacgggatagaggactaagaaaattacagaagttattgaatgaaatggaataggaaaaatgaaaaaagattatggttatccctcttacgaccttatttgcagagcgtctaatggagatgaaaaggcagtcagaggaattttagacttttacaacgcttatatctctaaagtatgcttgcgtccatgctatcatgcaaatggtactgtaaatatgcaggttgatgaagaattaaaaggtcgaattcatacagaaatgatgaaagccattttaaggtttgaaatcagagagaagtagtcaagtggtatgaaaaagggagatacacagtttcatttcatgtgctatctcccttgtggtttatattgtcatatcaaggctcttcaatcgtggtaaattcgtggtaaaataaatgtttttcaattttgaaattgcttataaatgtagtgtttatgggaataattcaaaatcttatataaaatttcaatgtaaattattgatagcaaatctttatgatttaccgataatagatattgcttttgcagaaacacaaattatggatactggcagtttacttacaaatatattatataactcaaaatttcaatttacagtgcataaaaatgagattatacgcttactgttatcaaaaattgcttcactaccacgcagatctacacccacatcagctccaacaagcaaaaagaaatcctgtaccataaaaatccaagaaatttcataaaccagagctgattgcacatatactgcatcccgcctcttgtctaattcaaatccgaacagcaaaaaagagaattcagagatactttgcgtacatgaattccctttttctataaaattgccattgtattaaagcattccgtaaatctctatctcttacaggaaactttctgatcaacgagagtgaagacttcccttcatttttggttatacactggctttccccgttcagccactcaccttcaacagctccagaatctgatccttatccatcctcatgatattcgtctcattctcttccacgaaaatatccgcaagctcctttttcatctgctgtaaatgctgaatacgctcctccacggtattgcgcataatcagcttatacacctgcacgcgggaattctgaccgatgcgatatgcccgatcactcgcctgattctccgccgaaacattccaccagggatcataatgaatcactgcctccgcagctgtcagattgataccggtacccccggacttcagtgaaataaggaacaccttcttttccttatcctgaaacttctgtacaagctcccgtcgctcctccttaccggtacttccatccattcggaaatacggtatatgcagatgctgtagctcaacctgaatcaaatccagcatggaggtaaaattggaaaacagcagcacggacttatcattctccacaagagagctcaccagctccatgcaggccttcagcttactggaaggctgcgatacctcctcatacacaagacgcgggtcacagcaaatctgccgtaagcgcatcagcattcccaaaacctggaaccgattggtcttcaccagatcgagctcctgctgcagctccttgttgacctgtgcaagattcgccatatacattgtttcctctgcctcatcaaaggcgatactgagcgttgtctccgtcttttcaggcagctcactcagcacctccttcttcactcttcgcagaatgaacggctgtaccattttcttcagctgctcctgcttctccttatgctttccaagaacgatatccttctcgaaatgatgggagaaatagcggtaatcaaacaggtagcccggcatcagaaagtcaaaaatactccacagctcagccagtgaattttcaatcggtgtacctgtcagagccagtgcatgatggctcttcagacgcttcgtgcttgtcgcattcatcgtccgctggtttttgatatactgtgcctcatccagaatcttatagaagaatgtccggctttcataatagccgatatccctcttcagataatcataggaggtaatcagcagatccatatccatactgctgcggatcagctcctcccgctttgcctgagagcctgtgatacagcaaacccttaaatcacttgcaaatttacgcacctcatcctcccagttatacagcacactgctcggcacaacgacaatgctggtgcggcctgcctgcttttcgctttccagaaaggcaatgacctgcaacgtttttccaagacccatatcatccgccagaatacctccgaagccataccggtgcatcagcttcagccagcgaaagccatccttctgataatcacgtaaaagctcattatagcgctgtggtatttcaatatcctgtgtactgatctgctgaaaggagttcagtatattctgtaagacatcctctttatggaaggcaatggagtcacttccctttgtgaatgcatccagcatgaacagacgatatcccggcagctgtatgcagttctgttgcagctgttcatcctcgatatgaaactcctgcatcatcgtatccagttcctccagctgatcactcttcagattcagcagcttcccgtttttcaaccgataaaaatgctttttcctgcggtaggcgcgcagcacatccagcagctcctccttatgaatatcacggctgtgtaaatcaatttccagaaggttacccgcaaggcgaagccctgcctgcagattaaccacatgcttcttattcatattcttcaatacatcactgacaaaaatctcacaatatcccgacagaaacggaaggccgtcccgcatgaactccagcagggtttcactcacatcatgaaacagcgcgcaatgctccttcggctgtatgatatccgcatactgccttatgaaattttcaacgatctcctggcgcagcggcagatattcctgctcatcctgaaagcccggtatccgttcatcctcatacagaacatccagctgaaaatacacccttcccagctcatcaatatccccatacagctccagtccgatcggctccagcgtataggcatacttcgcgattccatacatattcgcataatcacggatttcacttagaacatatttatagaaatccgcaaactgctcattgcgcacatacagctgctgctcactcagggaatcaatcagctccagacacttcccctgttcatcaaagcgatagcggtacagcgtatcatcctgcatgcggtacaagtgatgccgtccccgaataccgcttttcagcagcgaccagttgcggaaggtaagcagaacaaaatcctcctcactctttacgcggatgtccagcagctgtcgtttatccttcatctgaatgttgcgatagcgctgtggaaggcgccccagcagctcataaaactcatccatatacagcggaggaatctccataacactcggattggataccagcgtctttccctcataaaagcagtttttcagaaagcggatcagatcctggctgtcttcatcaaagcggtttatcgaatgggtgaacgccagagacataccatattgtgcataggtctgctgggcaaggcgctcaaagaaatccgcaagactgctgatggtataccatttccggtctccgattttcagtgcgatatacatatgctgctggtcagtgacctcagcttccacaaacagatgcaccttttccacatgctcacggttttgcagctcctgataatagaccttgctctcctgcagaatatgactggaggtcgcaaactgcttcatcagctctctgcggcgggtattctccttcaccatcgcctcgatgttctgatgctccttcaaaatttccatctgcaatctgcccttttttacaggtactgcttccttttctgcagaagtcctctgcttctctttcttaactggtgatggactctgctgaagcaacggaagttgtgcagccggctgtacggcgatttcttcctctttccgttcataggaatatgggaacttctccggctgcagatcatgaatctgatacagtacggcaagcagatgctcgcatatttttgttcgcttgcagctgcagaaataataatccacatcactctccgcatttaatgtaaactgcagtgtcgcataaaactttccactcaatgtttccatccgtgcctctacgtgatactcactctgcgtttttgctatatatatttttttgatcaggttttcctgttgaacctttctggccttgatcagctttgtttcactttttgtctgtcgcttaatatcatctaccgttaatctcacagcttcatccctttactcctgcttttcctatctttacaaacatgcaggtatcctttctattccgaatacaaaaaagcatccaatacgtcatgttacgtattgcacacttttcctcgcgtttcttcttatatgatacctgcaaatccaaataagtcaagccgcttttcctttattttctaaatccgtcaggaaaaacagatacgattcaccaaagcagcatgcgctgttaggcgctgatcgctgaaacaacagcagtctatgacagcctgtaaactctatatgctatcaagcaatggtatctctatcagcctatatctgtgtttcaaagcggtgaggcattacaaaaacagcttactgtacattctgagcttctctgtaataaggcatcccgcactgcagccatacattctgccagtagcacaaagcaggctacatatgccgaacccgcaggacatccacaaccatcataataaattcccggttggtcggcttacctttattcttactgatcgtattacggaacacggaatacagaaagtccacatccccgcgatccagcgttgcctctacggcattgcggatactgcgctccacacaggaaggcgtcgtatcataagcctcagctatcgttgcatataagccattcatcatattctttaatagctccggatgagcataaacttccaggatagcgctgcgcagataatagtgtcctttgatgtgtgcgggtgttcccatgtcatgcaaaagatttgtaacctcttcgtataattcctttgtcaatgtatccatcataaaattccctccatccatttctctgattccacacactaacaataatttaaatctgtccagaagtaaaccgatgtcgttatctgtcgaaatttataatttataaaagcgtttgtaattacaggccattgcagtcttatcagggtatcccgtatcgtctggtgtatttctatgatgatccttatgccaacagtaacaggcgttcacaattccctgccgcatataaaaaaatgaagggttcataacgaatccttcgagcgggcagacgatctatataagcatttaaagaccgccgcttattcaagcctgcacatccatctaacagcaggaagatatacgcatgccttattgcaagcatccacaaacagcataaagaatccaaatctattggtatacacaacaggttggattctcctttttctattcacactgagtaagcatgccgtatatcagaaaatgcttccgcatttactttagccagtcactgtggaacacccctgcctgatccacacgctcataggtgtgtgcaccaaagcagtcccgctgtgcctgtatcagattcgtttccagacttgccgtggtgtagccattgacataattcatcacactgcataaaaccggtatatacaagcccttttgcagagcgaagctgatgatgcgctgtaaatcctctctgccctgtttcacatactctgtaaactgatcggatacaagcagatttgtaaggtttgcatccttgtcataggcctgatatatatcctttaagaactctgatttgataatacagccattctgccatatcaccgcaagctgcttggtatcaatatggtagccgcattgcgcattcacggcagctatgagggaaaagccctgtgcatagatgctcgtttttgccagcagcaccgccttatacagatcagcagccagctgctcattgccggtttcttcatcctgtgtacctgcatagcactgttccgcctgtagccgttgggctttcatggaagaaagaaatcttgcttccacagcctctataaggcttggcacaggaacaccgtattccagagaaacacatgctgtccatttcccggttcccttctgctttgcgacatccagcaccttgtcaagcagccattcctcctgttcctttttttgcaggatatcctctgtgatatccagaagatacgaggcaagattatgctgattcagctgatgaaatgccttttgcacagcggcacgatcctttggatacagccttttcaggattgcataaagctccgcaagcagctgcatatcggcatattcaataccattatgcaccatcttcacaaaatggccggagccttcttttccgatataggtacagcaggctgtgccgtcttcatttttggcagcgattgcagtaaagatgtccgcaatttcgtaataggccctgtattccccggagggcatgatgctgggaccatgcaaggctcccttttctccaccggaaacaccgcttcctatcagataaaatccatcctgctgcagggactgcattctgcgctgtgtatcctcataataggaattcccgcagtctatcagtatatcccctttcgcaagcagtggcttcaaggatgcaatgacactgtccaccacacgtcctgccgttaccattaggatgattttacgcggtttctcaaggctgttgacaaaggcttccagtgactcatatccgaaaagcttcggatatttctgtgtaaactgctttgtgatttctgtttctatattgtatacagatacagagaagccgtgctgcatgatattgcgtgccagcgactgtcccatgacgcccagtccgtatactccgatattattcatagcgagcctcctcttcctgacggcgctttaattcctccttggcctgcttgagcagcttcgggttctgatacagcgtcagaatactgtttgccattgccttgctggaaatatcaagacagtgtttgccggcatcggatattgcgagctcgcgaaactgatcggtatggccggatatcttcttttccggaagcagtgtcatatagagattgcatgcgggaatcacacgggaaacatttcccagatcctctccacccgcatcactcggcattccctccatcatgggctccccaagtgccagcatttcctgtctgcacagctcagcgagcaccgcattcggcatacgcccgtaatatcccggtatttccttatagcttaccctgcagccgctggccagtgccatgccttctgcaatgtttatgattttctgtttggtggtttcgatatcctttgcccgcatggtggatatttccacctccagccttgcataatccggaatgcgtccgatatcccgttcactttccgctatgatacagcagatatgaatagaatcacgcagctgctgccgggcaagtcccactgcctgataaaacagattcgccgcatccagtgcattgatgccgttttccggatgggattctgcgtgtgcactcttaccgaagtactctatttcaaagtcggtaaaggaagcacattcgcctccgattcttgccatggcacttgtcggatgcatcaggaaaacagcatccaaaccgtcaaatacaccctgcttaagcatgatgatctttcctccgccatcttcctcggcaggtgttccatatacctcgatgctgccttccagctcactgctctccagaacctgctttactgcgactgcacagcctagcgcactggttgcgatcaggttatgaccgcaggcatgccccagtccctttaatgcatcgtattccgcaaatacggcaattcttggaccgtttccttttttgaacacagcctgaaaggccgtatccaaaccggcgattcccgtcttcacagcaaatccctgctcctgcagataagaagaaagcgcatgtgcagctttcttctcttcaaaggcaatttcaggatttgcatggatataggaggccagcttccacagatgatcaaagtgttcatctataaataaattaacctttttttttaatatttccatataaaatctcccctaatttaatagtttttaagatcttgtttaaactatatcaaagaatgacagtataagtgaagcaataataataccaattaggataccgccatactttgtaccttttttcttcatgtaaaaataaatacctgtaatcacagcaaaaggcaataaccctggcataataccatctaatatattctgaagtaaaatcggatcactattttccaatttaaaacctgccgttgttgttagtgatacaaaacttgcagacaacgctcccatcatcattagccctaggatactgcaggcatcaattattcgattcattagtccactttgtataagcttactgatagcgttacggccaagtgaatatcccagacggcacatatagtagccaatgaaatatccagccaaaggaaataacaatacgaagaatgcaccaattagattgttgcttagagccatcgttgtagcaagtgcaagacatataggtttaagtgtaccccaaatcaatgtgtctccaattcctgctacagggcccatcaatccagttttcaaagctattatcatttctccagaaatttccttatttgctgccttttcttcttccaacgacatcgtaataccatgaattacagaacctatagttccctccgtattgaagaattgcaaatggcgaagcagtgcctcctgatactcctcatcatttggatatagcttccgtaatgtattttgaatactggcacagaaagataatgactgcagtcgatcatagcaatgtgaaacttcacacagccaataccatttattataagctctgaataattctttttttgtaatctttgatttcttaactgctgctgtcatgattacacctccctttcttttttatttttaaggaacaaatataataaagcaatacatgttccgaaaattgcaactcccattgtagctacttcaaagtatataactaagaaatatccaattacaaagaatggtagaaattccatttttccaattgtatacaccgccattgcaaaaccaattgcgggtaatacgccgcctgctacttcaataccgtgcatagcccatgttggaattgaattgattaccccttcaacgagcgtaggtgccagtatattagcgagaaaaatcggtatagcagttagaaagaacgtgagtataagtgggtatacagaagcattacgtgtaactgctgcataatttccgttttctacgcttttttgtgcgcgaatagtaaacgttgagttgattgaatatttaacgttccatagtatagaacccagtattccaaaagggactgctaaaacagttgctgcgtgtgcatcaagccctgtacggagtgcaatcggaatagctaccaatgctgcgctagaagcacacgctggaacagtacctcctggataaatgattcctaaatacattaactctaaagatcccccaatcattaaaccttgctccacctgtccagttaaaagtccaagaagcgcacctacaagaacaggctgtcccagagtatcactcagggtataaccaaaatctgtcgttgatacaaactgccaaatcccacaaaatgctgcaatcagcaataaactagtatccatattcatttcctcctctattcattgaactctaatttttcaatcactttctctatttcatatttctgctgtgttggtacaacctgtatgtgaatatcacttccttccgctatcatttccttcaaaagttgtacatcctttgcatcaaacgagattccactggaagtattgattctaccagaacctccaccaagccctccaatttgtacctcaggaagagggaagcctagcctctgaagatttcgtatatcactaacgtttttaaataagagcaaaactttaccttctccgaactgatctgttgtccacttagccattgcatcatctactgtaaaaatatctaccttaacattagatggagcagccattttataaacactagctaaaaactcatccttagccagcatatcattaacgattataattcgatttgcatttgcctgtttcacccatttggtaactacctgaccatgtatcagacgaaaatcaatacgcactaaatttatatcagccatataaaaacctccttatttgcgctcattaagcaattttataacatcttttccactatctctcagtatttccagtcctacttcaactaactcctgtctagggcgaagatttctttgtgaggtcacctcgatatacatcgccagattcaatccggaaatcacctgcatgtcatatgttttcgacagaatcgcacatgtcgtacacggtgttccgccaaacagatccaccaggcacagaaccttaccatcacccagcttctccagctgcttctccagcattgctctgtaatcctccggctgcattcccggcatcagagaaaacgcaaatacattctctgcctcaccggcaatcatctcagcggatttcatcagttcttcaccgaatctgccatgtgtacagacgaagacccatacattatcctccataacttactcctttcttattaccttcactcatttactagcaagtcccatgccaaaataaaaaagtgcctgtttatcagcacttttccatctctgtatgctagtgtgtcattctgtgtcaaagttatccatgatgtaagccacttctgtgtcagagatgcggatttgaaattcccgctcaatgattttcatcgctgtacggacaagacgatacagcttttcatttcgctgaatacgttcctgacaggcatcatattccatctccgcaccacgaatacagcgctcaatcatacatccgacatgcatcatataaccaatcagtatccggttatagtcgtcaatatcccacattttggatatgacctggaaggatttgcgtatcacatcatctgcttttatcgggtcaaggaacacaagcgattccttcagaaaattattcatgacgatattggaggaaaccggctccctgtcttcaaccccaagtgctgtggatatgatttgtgcgatttttgccaaaccgtcctccagaatgattttatcactggaaatgtacagcgtatcctccagatgcagatctctggcaccgacaacggcaagaatacgtttattttccagatgcttttctttaaaggattccgtattgcatgcaacaatatcgatatgatattcgtctatggcaggaatggcggagcgaatcagctctcccagcttaaccgctgccccttcgccgctcagacaggtcgttacaatgacattctggtgcagggccttttgcttgatttccttggagtacagctttccgatatacggagtatagcttcgcagctcgcgatacaaatcgtccagtgtatattcgctcagcatcgttttccgcaaagcttccagtacaaacggtgtggatatcatatcgattgtctttgttggaattcctgttttctgtgtaatgatttccccaaaggatagcagggagcccatatcgacaagaatgaacaccccctttccctcatcaatttccttcactttgcgtgtcaccgtttccagaaaatcatccacactctgatgcaggctcatatcaagcgcatgaccatggcgtgtgtccagcagcgcgttggcaacatccaccatattgcgtgccacaccgtttccatgtgccagtgcaagaagtgcaatcgctccgtttacctgcggcttatccttttcaatacacagaaacattgtaaagaagacgatttcctgcggcggaaacggaatttccagctccttctgcaggaagctcatgatttccattgccacatgatattcattcggattttcactgagaacgtcgtagatgtttgcattcagctcatgctccttacgcttgttttccatcagtgcggatatatgcagcgccattgccgtatacacctttttggaaatcggatagccaagtcgctgctgagccagctgcagggcaacctctactgcatgatatacatgaatcggtacaattttgtaaagcattgcttcactcccggattcctcaatctgattgcttaaggttttgatataggtttcgatatacatgcgcatatgacggttgatgtttgcattgtcaaagccctttgcctcataatcctgaaaacggcggttcatttcctcataaatattcaaaaactcgccatcatagtgttccagctttgtttcctgatcatagacgaagatctcctgatcatgcatcgtcagaaaatcatcaacctccttctgcttgccggaatttaaaagaccgtgatagatatgctcctgcagtaaggacaaagtaatgcgaatcacgttatcctgacgggatatatgctccagaaagccgttggcacatagcaggcggatatccgccttcagctgcccgatgttccccttgcaatcgtaggacagcaaagcccgcatgaccttggccttaacctgaataggaattttgacctggttatattcctgacggaagaatttttcaatcagctcatagcgctcttcaatggagcgttcttccagagaaggcatggtgatcgtcatcggtatccttcgtaaaaaggtctgaagcagactggattccaggttttccgttgttgcggcgatgatcagcactctggcatccttgctagtttcattggctcccagcttgcggtattctcccttgtccagcagcatgaacagcatttcctgcccctccggaggcagccggtgaatttcatccagaaagaggacaccgttttgtgccttttccaccagaccttcactttccctgtctgcgccggtataggcaccctttacatatccgaacagctgtcccagcagaagctgtggattatccgcatattcggcacagttgaaaataacaaacggtgcagtcttttgcagtacaccatgatccttggcatactgatacatgatttccgcaaacatcgtcttacccgcacctgttggtcccaccagcagcgtatgcaggccaaacggcggatagatcatagccgcctttgccttgttgatcatcgtcttcagacttttatcactgccgatcagcttatcaaaatcattttcggtatacacttctcctcgttcctgcaaatattcctgcagagaggaaacagcaaaacgttccagtgaatgcgccagcaggacctccatgcgttccctgtcgaaataataaaccggtcttccggtgatcttgataactgcattctcctgaaaaagctgattcagttctttacttacattcgcccgatccatccccatgaaatcggatagctgctgtgcgctgaccccctcatagccttcctgtatggaagaaaggctgatgtctgcacagagctgcttcaatgtgtctgctaccctggattttctccgcatgttttcacctctttattctgatacgtgttcaatgcgattataagttataagtatttgaaagtcaaaatgtctgtgtgaatttcctgaattttactttacataagcaggcggtttctacacattatttatatcgctccttcctacgtaataatatgcataatgaaaaaaacatatattatatcctttatgtgctttcagaatgaagcgtgttctataccgattttataagcatacataacaaagaataaaaggtttgcaaagtgtgactgctatcagtttaacacgttttaaagtacttccagctgctgttcccataagctctttcacttgcagattcaacttatctcatgatattgcaaaaacaataaacaaattttagtggtacaaaaaagagctgagatgatacagctctttaaaaattactgtaggtatagctttttaggatagatgcagagattgcagaaccgtaggccgtatgtcttcttcaacatccagtatattcatagcatccaccgcactgacatcgattttctgcatcagtttttttacatggagtagtgttgcttccacttttccctcttccttgcctctttgctcaatgaaatcgctaaagttgcacatatccataacctccttatctatctccttctccattagtataccatacgtcttctgtaattgttccattttatcctctataacgagattttttataaacaaaatctttaacagctctaaaagcctctgcttgttctcatcctcctgctctaccgcatttggaatatcctgcgcttttcgtatgccttccttctttggatacaccatgaccgctgtgagcaagtcataatcctcccttgcggcatgccatatctttgtctcacacgtttcctgtatcttataggtgttgatgacatcattcttttgattgttatgaccgatacagatccagatggaacagacctttttgatcctgtcataatccgaatgctgaaatccatccttgggatgcttctgtcttgccatcaatctactgcaataatacaaagcacgcttgatcagaggataaccgggatcatcctttgcctggctttccagattgatgatcatgcgaactttcttatccgcaggtgtgctcttatcggctttcttatgcttcatggggattgtcgcctcgaactgaatatcgtatttgatctgtgcccccggtatggtttcatccgtgacctcaacctgatgatcatcgatatattcacattctgctgtgtttatagaagacatttcgatataggacggtatgtcctccagtggaatatctgcgtattccggaatacagcccttcatcacataggcgagaatctgcttgtttgataatagctttttacagtacatgtcatatttctttttatgatcatagcagctaatcatagctgctgcttctgttttcatttttgttgtcataatcatatcctttctttctcctattgctatctgtactttaaggatatgatccggtggtgctcttgttctgctgttgttttcattagcatacagaggtacctgctgtttcgtatcatacgcaggaacagatgcaacaaaaacaaggcagtccttaccgccgacaagcggtgttcagctgctgtaagctatttaataactgtaaggaatgaatgaaagcataagaaaaaacgcttctagcaggcggttgagctactgaaaggccggggcttttgcggatgaattagatgtgaatggattgtagtatttatatagtttctcatagaccgacctctcctttttttgtatttacagtgtagcatatatcctgttggaaatacagaaaaaaatcttaaaatcagagtatagacgaagtaaaaaaattcatttggtgaatgataatacagtcttataactgttttccagatagcccttatgacgcaatcgtcaggataggtagcgcttaggtgaatacaggttggcacagcagacttcaataaaagtggaaattgtaactgatattcatatctgataaacaaaaataggatgcgtaggctgtaaaactaacaacagctccgcatccattcatacacattctcaaatatacctttcagcactaatccttcttatcctctttcggcagcaggtactgcacacgcaccgatttctttgcacgctgcccctgtgcatcctcgacactcagctggtaggttactgtttttgcttccacaggcagctcctcatcccatccggtaatcaatgcactcaaatcgtttccagatgcatctgcagcagtaacaccagcataatcacgtacctcctgcattgtggaattggattcaataacaaactgaaaatccgcatgtgccgcctgtataaccggttttgcgttttccacaaccttaattgcaaaggatacacgctccttctgtaaggatgcaacagcctgataggtacccggtgttgtaacatcaaccgcagacaaatccagcttaaccttttttaatacatcggaatctgcatttacataggtttccgccttctgactcagctttgcgttctgctcaatgataaaggtctctttcttggcagcaatcgcattgacgctttgttgttcctccttcaacggcacataggcttccgcttttacaaatttctgcttcagcagtcctgcagtcaaaacaacagcaatcatcagaataccgattgccagtacagctttttcttcctttttaaattgaaaatacttcttcacatcatcacttcccaacttacttcaacgtttgtattttatcatatcccttcctgtaataaaatgcctaaaaatacaatttcagcctttatttatcaccttttttaccatatggtccggaaaggtatgtttgtgggattacgcattctgcacctgtggaaaatatgacattccatcgtttttcatttgtatttttttctgcttgatattataatcatactactcatgttggaaagctatcagctaccgtatagactatagatgaaataacacaggcagcgcgtttccattccatatttatacagagcttttttcatcgctgttatgcgggcaatatgatatgattaacctgtagtaagcagcacgccaaaaaacaaaacaacattttcgggaggtacgatatgacatttttacagacactgggtcccggcagcaccctcattgccccagcctacctgcacgcagctctgcgcgaggagcttttaaaaacacgcagcggcatgctgggactgaagctgaacactctgcagggatggctgcagcagcaggcaaatgttgcagtaccgtccagacatgttgccttatatcagtataagcagcggatacagacaatccttccgcagctgaaaatctatcgtgaggtggcggactccccggtatttctgaacgaatgcaggtcgtttctggattccatttatttctggaacatcccccagagtgaactgcctcaggaaagtgaagctcaaaaagaactgtttgcaatcctttctcagctcacggatattgccgtgccttccaaacagcagcgtgcagcattaacgaatataaaaacaaagcggctggatgatctgcatattctggatgtgtatcacacgctggaggaagaacagctcatacaggcgctggttgcgcagggggcacagcgctgtactccgccggtgtatgagccaatgccattgtttttccatgctgtaaacaagcgccaggaaatcgaagcatgtgcacaatatattatcgagcacgatctggatgcggatgatattcatatcacccttgccaatgcaacctataagccgattcttgcacagattttccagcgttatcaaataccgtatacactgctgcaggattcccatgcgagtatactgccacaccgcttttccgcattgttctcttattatctgaagccggatacggaaaatcttctccgtgttctggattgcggtgtcgtacacatggaacagctgcagaagctgaaggattatctggatgtattctcctgtgatatcgaggaagcctttgaccatttacagcagattgaggatgagggacatattctcgatgcacttgagctggccaagctgcaaaagctggaagaagaggctgagctggttcgtcaacagctggtggtctatctgcgtccgctgaaacagccgatatcgatggaagcgatgatacagaccgctgcttcctatgtcagagaatctctgcgcagggacgatgcagataccaaaattcttctggatattgaggcgatgctgaaggagctccatccttatatattagaaaaagaggatattgcattttttctctatttccttgacggtatgacacaaagcagtgctcccacagaaagaagcggagccatcgtctgtgatctgcgccagtcccccttctgccgaaagcatttatttgttctgggatgtacacaaaaagactatcctgcctttcaaacaaaaaaaggcattttcgatgagaactatcacgcattgatttcagcctatccttccatggaacgacgttatcagttttatctgaaacagatatccgcaatgctgtacgcagcaccatccgtatatgtatcctatccgctcggcacctatgagggaaaaggaatggaggctgccctggaaattgaggactatgtccagaagcagcatgcgaatccaaaagcgggttcagtagcttatccgctgtatagcagctatgaacctgtttccaccaacattacattgtctcctgaaatggcacaggctctgtttgttaaagataaaatgatccggggctccatttccgctctggaacgctatgttaaatgcccgttctcttactttctgcgctatggtctttccttgcgggaaccgatgaaggtcggctttccggattcctatgccggcactctcgcacattaccttctggagacctttacagggaaatatgggaaggcctatacaaaggtggcagaggaaaaaatcgaagaagtgctgatgaaggaaattcggattatgcaggatgtgtttccatctctggaaaaaaagctggaaaatgtagcacagcggatacttacctctatgacacagaccttgggcttgctggatgactttgaacagcattccatattatctccgtatttgcgtgagaaggagtttcattacagcattcccttaggggatgacatcagcctcgcattaaagggatatattgaccgcatcgatgcgtcggatgaattcttatgtattctggattataaaagctctgccaaaatgctgtcggaggctaacgtatttgccgccttgcagctgcagctgctaacctattccatcgtctgcagtaaagaatttcataaacgtgttattggatccttctacgtttcgttaaaaaatgaaaatatcccttatacggcaggcaagctgtcccggagaaaaccggtaacacatcttccatccagtaaagaggaatatgaagaaatccgtcacaaggcacaccgcatgaacggctgggtcatggacagtgatatacaggcactggatgacaacggcgcacacattgttggtgtgagtcagaataaggaggggatcataaagccgcgcaagttgtatgatctcggcagtatcgaacgttattttacaaaaatgtatcaaatgatcggtaacagaatcataaacggggacattcgctgtttgccgatggaagaggcctgtatgttttgcagctattatgaaatctgccgatttaagggcatatatgcagaaaaaacacagctggtggaggtagaggacgatatctatcagcaacagaaaggacgtgaagaagatgcctgaatggaatcccatgcagctgaaggcgattcagacaaaggaacacaacatcctggtatccgcatctgcaggaagcgggaagaccaccgtgctgattgcacgtctgatggatctggtcatgaaggatcatgtctccattgactccattcttgccatgaccttcacggaagctgccgcaaacgaaatgaaaaagcgtctggccacagagctgcagaaggcgttgaccgctgcccgaacagaagaagagaaaagctatatcaccagacagctgacgggtatacagacagcacatatatcaaccatccattccttctgcctttccatcatacaggaatattattacattctcggactggatccgcagcgtatcaaaagcattatggataacggaacgatggttctgtttcagcagcagtccctggaggaagcctttgcgaaacagtatcagctgcaggatgcaagctttctgcagctgtgtcagatgttttcagcaagagcggaaaacgatgaggccctgcgtaccatgattatgaatcttgcaggactggcctccagcaaatccgatccggaagcctggctggattctctggcagagaattatcatgaaaagcgtctgctggaggatttaccaaaagagatttatgagaatttctttgaatatctcgttgtgcaaactgcacgttatgaagaaacgctggtccgtatagatgagctttaccggttaaaatatgatgatcaggtaaaaaaacacgctatagtggaacagaagctgcttgctcttcaggacctgcatcaggccttgcaaaatcaggattatcaggcttaccgcgctgcctttctcgccattgtacacgccgttgtacctccaagcccggataaggaggataaggaatatgcccgcctgagaaaaagtcttcttgctttagaggatgcacaactggaaatcctgttcagtgaggatgaatttatgcgtgatatccgctacttgtatccttatataaaaaagctggtggacatgtgcagggattatcgcagcgcctatgcaaggataaaggaagagcataaggtcatcgactttgatgatatggagcatttcgctctggaaattttacaggcgaagggtggccgtgttgctgatatctatcgtgaaaaattcgttgaaatcatggtggatgaatttcaggacagcaatgatgttcaaaaccagctggtaatgctgatctgcagaaagaacaatgtattccgtgttggagacatcaagcagtcaatttatggattccgtcatgccaagccgtctttgatgaagggactgatcgatcatcgcggagtatttgatgaggttatttatctttcaaataattaccgttccaagaaaatgattgtcgattttaataatgacctgtttaagctgttgatgaatatcgatggattttcctgcagctatgcaaaagaggatgatgtagaaaccggtgtccctgcgcagaacgaggataatgttcccatctgtttccatgctgtataccataacgaaattaaggaagcagaggggattatcgtttccaaaaatgaattaaaggcaagctatattgccaatcagattttggaaattaaggagcgcgagcagcgaaagtggaaggactttgttgtcctcgtccgtggaaatgcccgcaaggatgatatgaagaagattttcgatgagctgaatatcccgtatttcattgatatcaaatacggattctatcaatccaatgccgtacaggtgattctgtccgcaatgaagtgtattttgcatccgcacgatgatatcagctttactgccactatgctgtcaccgctttttcgtaaatcaactatggatttcgcacaggccaagctgcagaaggaaaagggacaatcgtattattcctggttctgtgagcatccgtttcccggatttgaaatattacaggagctgattttccaacatggcaggctgcgcatcagtgagctcataaataaactgtatgagatgcaggattattatcgtctgcatacaagcattcaggaaaaaaccaatctggatctgctgtttgaaaaggctgtacagtttgaggatcagtatgcctccggattatcctcctttctttcacagatcgaacagatcaaggatgctcagacagcagaagcgattccgattggcgttgaggcggatgtggtccgtgttatgagtatccaccagtccaagggtctgcagttccccgtcgtattcctatggtctaccgataagcagacaccaatcgaatttaaggatttctgtatcagtgactccgagctcgggctggcaatgaaggcaatggacttaccgcagcgctatgtccgcacaacgataccgcgaatcgccatggaacataaaaaggataaggaagagctggaggaggagatgcgcattctctacgtggcaaccacccgtgcccagacacagatgcatatcgttgactgtatacttgagcttgatacctataagcatccgttgagcatgtcacaggtatacaaccgcaatggctatacatcatggatactacaaacgtttctatgcaacccaagtccactctttactgtaaaggaggtgcaccgcctctggcacagtgaggtgcagcaggcagaggcgggcgtataccatcctttccgggtatatgaaaagccatccaaaagcattgaactggtaaccgcttccgcacaggagacaagggagctgcctgcgtttacatttgacgatgacatgcagggaagtgattatggaaccatgatgcataaaatgatagaagcacttcaggctccggtatggagtcgtgatgttattctccaagtcgccaatcagcagctggtggagctgaaggaatgggatattcagacattgctgcagctgggaaaggatccggattatctgtcggcatacagaggggatgtccatcatgaaatgccgtttatggttaaggacggatcgcaaattctacatggctatatggactttgtcagcattcaaaacgaccttatgatcatccttgatttcaagacagattctctcaaagaggatgcggaattcatacaacgatataagggacagcttgctatgtataaaaaggctatgcatatcttatatccaaagcatagtatcacgacctgcatctattctctgcatctgcataggatgattgccatttcataacaaaagacagaatccaagcctgagaacctcctcaggttcatgattctgtcttttttgcttatactcgattcataacttgctttccatattatgaatattccctgtctgtgatgtatctgactgtatacatgcaacagatatggtgttgtttcttctgctctatcaacagttacaatcgtcaacctgcagtatgcctaaagcaggacagcagccccttcattaaaatatcgagtgtccttccgcacatccaggcacaaagcttcccttcatttacgctttcggctctacagcaataaacagcttatctctttccgctattccgtaattctttgaaaagaaatcatacatcgtccaattataataaaaacgttctgcagggtaaataccatagccgtcctgattatggtctgttgtatcataggaatccgccacgataagaacatcatcctgtgttgtttccgtccccatggtatcatatccgatgattacctgccagtgtcctccccagtcattccatgccaccataaccggtatacctttttttaaaaaatcctgaatcatgcgcagattgattttatcgtaatcgctttccctgtaatcatacgttgaatgaatctgaaaccctccaacaccttcgaaaatctgtatcatggattgtaaagaggtagcctcacttttcagtttatttgtgcgaagctgcgcaagtgtttcctcattgtgcttaccgagcttcccgtaatactgcaataccatgagtgccgcatccacaccgcagctccattcactcgtctgctgcatcgttttaaatttcggcagcaaggtaagcgtatcggtagacttcatatgatagaaatccggatgcttgaaatatggtgattccttttgatcaccctcacgctccacactgtctgccccgtcatcttctgagagatccactgtatgtgcaatcttcatttcatcactataattttccttttcctccgttttcacactgcagccgaaaagcagtaccgctgccatacaaaaaataatcgtttttttcatcatgtcctcactttcttagtgagtataatacctgcatatgcaaacgtgcatactgatcctgttatatccgctgtgctgtatgattctatgttcataaaaataaaatataagggatatcctgagtctatacgacaaacatctgcctttactactcttattgatcttacaagtatcgatactcataaaactggctttaaaccaacaacaagactttacactcacaataatcggcatttgacctggctgtccgtatggccttttttctggggtcaaacgaatgcatattgcattccatgcaattagggtggtgtagcataaaggttttcaggacatccctccacttcttctatgagcggaattataacgaaaaggaaggtatttcacaatactaaatataggtaatatcaaatacaggaacaaacatgaaactgtgtatcggatgtaaaaacaaaggggctgtgacgagtaagagaaattagtgtttctctgaaaatcacagccttttttattatgatttttgtattttgggtacactgaaaacaactttttgagtgaatctggttttaggcccttttttcgttagaaatcccccatcccattgtggaaaactaattcagtttgcttacatttctctgcttttctctttttttatcccttattttataattatggtactttcttatgttatatccaatacacactaagcttagttctaccttgactccgctttctcctcgtcgatgcaagcggacatattcaaaatcttgtttgatgtccgcaaacgctccctctgcctgtgcactacgatttctcatcaatctctttccttcttcactctttagacattcatctatctctttatgcatcttttctaaggcagggactatccgtgcacttcttccgttctttgatgtcgtgcatttgctcctgtgtggacattcaccgcagtttttatttctgtaatacatcgtcgtttttggatattgtcctttgatattgagtcctattcgctctatctcaaatacatgtccggctggacatactggagtaccatcctcttgtcgttccatgtgccgcagttgatagcgattcttatcatttactttctctttcttcttttcatatccactgtatttcaatagtcctttaatccctttacttttgcagtaacagtaattatcatagctcccatatcctgcatccgttacttctatatcagggtattttccatataattctttatatccttctgtaaatggttgtaacgtttttatatcatttggatcactacttagatattgataggcgatgtacccattatttactcctatttgtacgttatatcccggtttgaatacatttgtatgattgtaataatcatatttcatatgcatgaatgtggcatctggatctgtcttggaaaaactgttcctgtcttccaatatatcttcctggattgcatactcccacatctttactgcacttttcttcaattcatcgcacaattttgcgatttcgtgttttcctctgccttttcggatatattctttttccttcagccaattttcaagcgcttcatctattttgatcatatactcaatatttggatatttcaaaattgaataattgatattgatttcatgttttttaaagtatcgattcacttgttttaacagttccatacatttctgccagtgtctgggaaggtatcgtttactccaacctttccaacagaacgtcatcttattggcatttgcctcaaattttgtaccatcaatataaagaatctgttcttccaatgctttttcatcttgtacatacagatagatttctttcgcaatcgtttgaatggattctttcaatgtatgattgatgaatcgttcaaagctcttataacttggaacacaaccgttcgtgatactacggtaacgaatatcatagcgacaaagtttttccagttttcgtaaagaagcatagccgtcttcagcaaaggccatgaggatgatggtcaacatcatgacagggtcataagagcgagaatcaagattatggaaatctataaatttatttagattaatcctccctaagacttccaagatcgtgacgctcaaatcatcatcaagaacatcattttgaaaagaataatcaaaatttagtagcatatatggttgatatgcggtataatttccttggttaatttgagtacttgtcatacataaattataccaaaaaatacaccttcttctctatagaattgggtgtattttttatgtctgggctgtgacttatctgtcacagccccttataagataagctcctgctgtactcctgcagagcgttttgtcacatatttttttagagcctccatgatagagtagatgatgttttccagaactcccaaatccatactctgtacaatcagctggagcagataatcttcctttcccatgtcaaagtcattatcaaacatcagcagcagcattgccagaatatagttttctctgaggtattcctcatcctcctgtaaaaggtcagaagcctgcagtatggttgtgcggcagtcacaatttttcatccagtcacagaattctctggacaactcgatccttcccttgcgataatacaggcagtccccctcctgccataaaacaaaccggctggtgaaatcctgaattcgctgtgtaagtggcagacgccagtcctcataaggatcgagccttccgttattatccagatctttaaacgcaaagccgtcctgctcgataatctgaataccgagattgggatcatagctgagtgttttaccgcctttattttcaatgcactcatgattgtgcctgtgagtcaatttccattgcataaacagaaacctccttgtgtctttctacctgtagtataacaacactcgccgcgtatgttgtcaaacaatcttgtgaaattgtgggtttacgcatatctttcggaagccttcacattttgtacagaaaaagaacatacagccctttatactatatgttcttctttctgcatgattccttataatgcttttttctgtgcgagcatcttaataatttccacagtgccgtcaataccgaacgtagaggaattgatgctgatatcataattctctgcacgaccccatttgcgatccgtatagtactcataataatttgcacggcgcttgtcgattttcttgatgctgccctcgatatcgcgttcatccacctcataggaatgaaccgcacgctctttgcgatcctccatatctgcatgaatatacacattcagtacatcactgcgatcccgcagcacataatctgcacagcgtccgacgatgacacatgatccctcacaggccacacccttgattacttcttcctgtaccagatacaagcgatcatttaatgataattccgttatcgtggacaatggtcctcccagagaatatcccaaggcacccaggagtcggaaccccttgcttgtacgggcatcatcttcttcaaaaagctctttatccataccgctttctttggcagcaatctcaatgagctccttgtcatagaacggtattcccagctggtcggctattttcttaccgatttcacgtcctccacttccaaactgtctgctgatggtgataatggtcttattttccataaaaatcgacctccttgttgttacttttattatactatgttactttcacaacatcaatgaattgacggccattttctgaaaacagtcccgtttaagctataacagagaaggaaagcagtacgtagttaaaaacggtatgcaatcatcaatttcctgccgctttctctgcctcctctgcaatgtttaaaactgcaaccacctcctccgccttcacatagggagcctttccctgataaatacatgcgtacaggtcatcataaatcttaccataatccgttaccctggagggaatgcgggtcgtaatatcattcccatattcatccatatatgataatactccccagttatcctccggttcctgcagaaaggaagcctcgataggctcctgtgcagattttgcgaacagatgcccctgactgtatttcataaaactgccatttgtgccatgtacaaggaatctgggatatggcagcttcacaaacaggctcgttttaactgagaccttaagcttaccgtaataaagcttaatatcaaaataatcatcggctccctcttctttattaagaatgccttttacatcataatccgttctatcaggaataccaaacagagctatcatttgatcaatcgtatgaatacccaaattaaaaatcatatcctgtgttacaacagggcgtgttttaaaataatcatagtgagattctatttcaatgagcgtaccaagctttccactttctatgatatcctgcaatataagaaaatccgcatcaaatcgtcgattctgattggtatatgcaaggcatcctttttcctgtgcaagcgtaaaaacacgttgtgcatcactgcttttcattgcaaagggcttttccaccagaatatgctttccggccttcaaagccatttctgcatagcttacatgtgtgtgatttggtgaattaatacaaatgacatcaatttcagaatcctataaattaacctgtttatatacctctttttaagaaacgcaggaaatcatcagcgcctttagaacctgtatcactttaatgacttgctgttccagatcactgttatctgtccgtttttctattttcagtgatacgcatccattatcgcagctgccggacgttaacaaaatatccccatatgcatgcttatcctctgccaaatcatgccattccgcatgctctgctagtttctcatgaagtccctccagtatatgccggtcagcaaatccctgcagctttccgacattcccgatggaatccagatacacccgctgaatacgcttcttccctatatactcctgcagcatgcgcagaccatactcagaacgtgtgccctcatcaatcatagcaaaggctacgtgctgcttttcctgttcggatagatcccaggccaaagcaaacagggcaatcagacttgaagaattgcgcaccattgtatttcctgccgctattcctccacgcatatgccgaatcccataaaaaccgaacaaacatacgagtacaagcaccgctccccatagactcacaaatccgtgcttctgaagactgggaatcactgtaaggtataaaaatgcagcaatcgcaatcatacagcatagaaacagcaaggtatggagaaggaaatttccccttgaccagttcgcatcaaaggctttctgctcttttgggaaaaactgccacagcggcgtatcataatacgtgatgaagaccacatccgcttttttgaaatcaccagcgtaaagattatacatatttacagactcccgcctcatgagcgaagcggatacacaggtgatatccacaggaaatccggcctgctccagctgtttctgagccgctctcaaaaaatccgttttctgtctttccgtatttctttttccaagaagcacgccataacgcagaattacatcctttacgctttccttctccatcttcgtcacctcacgtattcagttgttccagcattgctcgcacacacgacagattttcagcgcagacaacatccgatgccgtatcctccacatcaataaaacgataatccggtatccgcacggtttgaattcctgccgcaatcgccgcctgcacacctgtcagggaatcctcaaaggctaccgcatgctcacagggaacctgtgcccgtcttaaaacctccagatacaaatccggataaggcttcagctttattacatcatctgcaaacacgggaatgtcaagataggatagcaggcccagatgtgcgagtatggcagtcgagcgctttttcagagaggaggtcgcaagccctgtccggtatccgtattcccgagctgcctgcaaagcatcccgtgcatagggcatagcagacagcgtaccattctccagacactgatagatatactgttcccgatccttacgaatccttgcgcacaatgcttcctcatggcatacctgcatcagatatgcatgtgtatcatgaaagctttttcccacccagcttttcaccacggcttccgcaatagcaacctgctgcttgttcaaggcatacagccagccctccagatagacgcgctctgtatccacaagcagaccatccatatcaaaaataagaagctctgttttatcgctgatcatatgcacggacaatattcaccagcttttccgcctccaggcgtacagcttcaaaatctcctgcttcagctcccttcgtgaggcttccaccagttccaaccgcaactgccccgttgtccagccactccgtcagattggctgcattcacccctccggtcggcatgaaatccgcctgtggaagaggtcccttaaaggctctgacagccttcggaccaaaggtatcacccgggaacagcttgatcacatctgccccatagcgcagacattccagcatatcctttacattggcagccccaggaaagcagggcacacgatagctgttgcacagcttcatgacctctgtatccagatgcggacagaccacaaactgcgcgcccgcagaaattgccatgcgtgcagatacgatatccagacaggtacctgcaccgataatgatatcatcacaatgctcatatgccttgcataaatgcgcaatcacctgttctgcctgtggtattgtatatgtgatttccatgaaatgtattccaccgcgatatacagcatccacaatgtttgtgacttcctcttcatccttaccgcgaatgactgctaccagcctctgttttttcagctcagccagcaaagttgtcttatccatatgctcctccttatcctgtaattgatacgtatctctatgcctccagcgaacaaatcagattttccaccgccatacggctcatggcgttaatagcctcctgtgtggaagcggccgtatgcgaactcacaatcacattgggaagtgtcaggagcttggagttctgcggcggctcctgctcaaaaacatccagccccagtccgtaaagcttcctttccttcaacagctcatacagcgcatcctcatccagcagtcctcctctggccgtattgacaataatcagattacttttcgcacgcttcagattttctttattcaggatatgacgtgtttcctgcgtcagtggaaggtgtagagaaatgaagtcacattcccgtatgattgtatccacatctgtaaagcatacattatatttattcaagaaggcatcatcccttatgatgtcatatccatagatatgcatgtcaaagccgctggcacgctgcacgacccccttccctatagcccccagtccgagtacaccgatcgtttttccatagatatccaatgcttcctttttggaccagtcattgtgatgacagccctcattaatttccacaacacgccgtgccacactcatcaacagagtcatggcgtaatccgcaaccgcattggcattcgcatttacagtgcggcttatggcgatgtcgttttcttgcgcatatgcacaggcaatgttatcgataccgactccgtactttgcgatagcccgcagtctgggtgcctgcctcagagcctcttcactcaccggatcaacaccgacaatcagtccgtccatatcctgaagtgcactgcgcatctgctgctcattcataattgtgccgtaaggattgaagacgggttcaattccatgctgtcgaagcttttctatcagctcctcgcgattatattttccaaaggaacgcggagtaatcaaaacctttttcatcagtagtcctccccgttttcttcttccttcaccaccaacggctcactgatgccatcccgaccagccgcctccgcaatcgcaacaagctccttaagggaggaggatgcccgcattgccgcggtttccagcagcattgccagattcataccggcaagcacacggacacttattccctcctgcgccattcgggccgctgcatatacagacgcattaaacggagaagctccgtaaagatcgacaaataccagtacaccatctccactgtccagctgtcgtatagcctccatgacctttgcacgaaagctttcaaaatcctcacctgcgcaaagagaaaccgtgtgcatccggtcacagcttcccataatcagctccaggctgtccagcattccttccgccattcttccatggctgaccagcagaatcccaatcatgcggaatgctcctcaaacaggcgtgcagcctcttttaaagatacacggcgtgaggatggaatcgcctgaaaatatacatcaatgccatagtctttttccagctcctgcaaaatctttagctgttctttgttgattgcgacctccttaatgattgaggtcagtcccggcttctgtggaataccgccaagattcagctctttcatcggcactcctccccgtatgatatctgccatcacctcgatgctcttggtcagcagaatgacatgatagtcatcgtactgccggtcattccagtatcgtacagcaccgtcctccttcaaaacccgtaccttcaggccggtgcgtgagcctgcaccaagaatgatgttctttgtaaacggatcgtgtgccgctggatcatctgcgacaaatatcgcagttgccccagcggattttgacagactcgtcataacctgtccgtgaatcagtcttgcatctacacgtgccaacactaccttacccataacggttcctccttaatgttacagaatgccaaagccggccagtacgccgaggataatcgtcagaccgatcagtgccttcgtgacattcaaaccctttttagtgaaatagaaatataccagccccacagtcaacagcggcaaaatccccggcatcacaccgtcaaggatttcctgaattacgaatttcttaccggacagggtaaaggccagcgtagaggataccttgacatagttggctgccagaattcccatcatgaacagtcccagaatcgagagtgcttcaataataatctgcatcttcgtaccgacgacctcagtggcagctgtgcgccccagcttgaagcccagctgcgcgaagtaatagccgataaccagctgatacaaggagaacatgacgaacggaaacaaggcgccgattgcgtttccctgctgtgcccacggtaatgcgatggcgataaagatatattgaatcgtaccggagtcaatggaatccccgataccagccagtgctcccatcaaaccggccttcgtgttgtaaatcagatcatcgtcaattgtgacgggtgtatccatatacacctcctgcgcacgagctgcctccagggaagccatgattcctgttatggtacctccaccccacgatatctgtgtattgaagaacagcagatgacgctggtaggcctcagataaatcctttttgtccttatacagctttttcagaatcggcatcagcgcccacatcagagacggtgcaatatatttatcaaaggaatgcggaatctcattggcgaaatagaagcgcagccatgcaaggctgacatcccttttcgttattgcttccggttccagattcacgcttttctgcagcatttcactcataattgtatccacctttccataacttcatcctaatagtcatcctcttcctcgttgtctgcagtattgattccggaagcggagaacatgctcacagcctctgttttagacagaacgaagataaaggcgatgatggtaccaatgattgcatacgtaatcattgtgatattcagactctttaatacgacagcgacaaagtaggcaagcaggaagaaagcaatataattcttttttccgattacataaatcgtaacagcgataccgatggatgccagtccgcctccgattacctccagaatatggaagaggatgcttccggatgtggattgtacgatatccgcgataaccggtgctccataatacagagatacgaacatgaaaggaacaaaaatcagaaaggccaccaggatcggaatgaaaatgatagatattgtaagcattttatcgttggcactttttgcgtatttatccgtgaatttctgcataacgaaggtgttgacgaaaaagcggaactgatacagataggaaccgagcagtccaaccggtacagcaacggcgatagctgcctccggcttcatatctccaagcaatgccaccggtacagcaatggctgcggcaatggcaggctcggagggcatctgacctcccggagaaaagacccccatataaatcagctgaatcgctgcggtgataatcatcgcttcagcgacacggccgaatacgagaccgacgatcagtccggtcatcattggggtaaagcgcagtgtcgttgtggcacctcccaaaaatgaacgtgacataaccagaccgatccagatggaaataactactgcctgtacaatcgtgatttgcatatttctgcctccttgaacgtgtacatcattctgcggttttgtgaccgccaaatccctttctcagtgatgcgacgactttccctgtgaaggtatcctcatacaacgagcgatagcgcatcatcagggctgtggaaattaccggaacgctgacattacagcgcattgcctcctccactgtccattgtccttctccggatgcatacatgattcccttcacggcatccagcttttcatcctctctgaatgcctcctcagccagctccatgagccagcttcgaatgacagagccgtgattccacaatcctgcgacctgtgcattatcatagggataggggctgtgctgtaatagctcaaagccctctcctatggcctgcatcatgccatattcgattccattgtgcaccattttcagataatgaccgcttcccgcatcaccggcatacagatacccctgatccgaagcaatgcgttgaaatagctcttcaataactgcaaagtgctcacgttcacccccaatcataaagttggctccctcaagggcaccgcgaataccgccggaggttcctgcatcatagaaatgtatctttttcttttttagaaattcataattacgtagcgaatctctgtaaaatgaatttcccccgtcgatcacgtaatccccttcctccagcaactctgcaagttggtgtaccatgctttcggttatgtcccctgccggaagcatcagccagattatacgcggtttctgcagaacagcaatcagctcctgcagcgtttgtacaaccggaattcccttcgcttttgcctgctttcggggccctgtctgtatgtcatacccataggcgcaaattccactgctctgcatgttcatagcaatatgaagacccattttccccaaaccgattaaacctgcttccattcttcatctcctttccgtgcactcaatccgcatcagcagatagcgcttacaccatctattataaaaataatttccatattgtcaatcatattttgcaaataatttccaatgcatgaaatgtttatatccgtgtaaacacaagttgggatgcgttggtgacagcttggggataaagcttcatatatcccattatattcaggtttattttcatttatgttgaaaaaaaatcatatcgtttattttcacatttcattcgtaatccgggataatccactgttaatcagacaggtaatattttcatatttggatttaatatataaaataatttttcaatagctgaaaataatttccaatataacaccacatttcacaatatctgttataatataagtatcagaaacggggtgtatgtatgagtatggaatttgcagggcgggtgaagggtcattattacggtttgagtaaaacggagaaaaaaattgccgattatctgctggagcatgcaacgaccgccagacacttatccattcaggagctggcagaggatattgatgtatccatgtctgctatctcccgattcaccaaaaaggtcggctatagcaactatcaggaaatgcggctgcagctgagtgaaccatttgatcatctgagcgaagcgttttttgcgtcccttgatgagaacgacacagcaatgaatatcgcaaaggctacctttcaaagcggtattacctcgctttcctcaacaatggcggtattgaatcaggattctcttgaacagtccgtacacctgcttggaagagcaaaaacctgtggactgtttggaatgggagcttcctccgtcattgtacacagtgcctatcagcggtttctgcgaacctccttaaactgccagttttcactggattaccatatgcagctaatgtatgcaggaaggctgagtgaaaaggactgtgccctaatcgtatcgcataccggaagaaacaaggatgttctgcgtattgtggatatcctgaaggagcgcggtgtcccaatcatatctgttaccagcaacgccgcatcccctcttgcccggaaaagtgatgtttttctattttccatttcagaggagacaaaatttcgtccggaggcgatttcctccagtgtttcccagctgatgctgatggataccctcttcacactgtacgccatcaaagaggataatgatccggagtacttcaacagaattcgccgaatcgtaaacacgaccagaattccataagaatatgctggaatgaacatctttcatatgccctgatgctggaaacataaaagaaagaagctcttatacgtttatacagtcagattttcctgttcatctgtgtttaaaaggagagagatatcaggcaggctattgcgattcacctttgttccatcatcctctccctatgttcatgcaaaccaattttgtatattccagaactctttttctgtaaatattaacataaataaatacaaatcgtataaatatcaagcttattcattttcagtaaaatttcgtggtattattaactataaaattttaggagatataagtatgaaaagaagaaaaagagtcaaacgaaaagtaaaaatcgcagccgtcattgtgctgcttatatgtatagctgtcagtctgataatcataaaccgaactcgtattcagctggcttttaaagggtatgacagggatgaacgcaatattataatgacattaagtgcacaggagatcgatgagtatgtatcctttgcgtcagacattgatatatcgaaatggaaccggatgaaaaacaataagcattatctggattatgaactatatgcagagaatggcgctgataaaaaagaagctgtcgcttatgttgatcagttttatgcagactattatcaagccttacgcagccaggggtttgatcagccaacccttcgtacactgatgaaaaagaccagtcttgctgattttaaaacaataaaggataagaagctgacctggaaacagattcaaccttatatccatataaacggacgtatactggaggatgtccctgactatctgaaatcaggcttaaagcctcttgaagcagtaatgcgtatttcatatgcgtccataaattcttcagcaccaatcacaattcagcgatcctattcacttgatgacccaaaacatctattactgatgatcaaaagaggcttttatgtaccgaaaacctacgttcctgaaaatttaacagctgttcaaatccccgtagctcacaatgacggaaacaatctaatgcgaaaggatgcggcagacgctttggaaagcatgtataaggatgcgaaaaagcaggggcttattctagctattaacagtgcgtatcggccttataacgaacagcagcaagtgtatgatgaatatatggtgacctatggtgtacagacagctgtgaagctggtagcagagcccggctgtagtgagcatcagctcggattgagtgtggatttaaccagtcaaagtgtcatggacggcacatatgcggtattcggagacacaccggaataccaatgggtaattaaaaatgctcacaaatacggattcattttacgttatcccgagaataaaacaaatataacagggacagcaaatgaaccgtggcatttccgttatgtaggaactgaagccgctacagaaatataccgtaaaaatctgtgtctggaagaatatacactgcagcatggtttctcatatcccgtttcaataaagcgctgatagcaaatggatgatattcattatgaaccgtccagttattttcctatgaggtcaatacgatttttatttcatactggaatgtatcctttttatgtattcggagttttttctgttataatactagtagatggttatcccattaaataatccagcgcgaaccattagctcacatgaattccctgggaggttcgcgcatcattttgttcaaattcgcacaaatgtaacaatttcaacgcaattttcattaaccaaagttttataattgtgtaaatttgtttcatttaggggatttcatgggatttttcacggtctagcctccctgaggctagtggatctaaatagcactcatggaagacagtacatcggtctgttttgtctagcctccctgaggctagtggatctaaattgggcatttatgtttacatcgatagctcttaggagtctagcctccctgaggctagtggatctaaattgtgctatacagagcgacaaaacttcgtgctctatgtctagcctccctgaggctagtggatctaaatctctactggtctgttatacattgcaggagatgaaacgtctagcctccctgaggctagtggatctaaatatctattgtactgattatgtcatacctagaccatggtctagcctccctgaggctagtggatctaaatttttacgaattgataatcaataactgtcatttcagtctagcctccctgaggctagtggatctaaattcccagttttagaccatgaaaccgataaaatgcgtctagcctccctgaggctagtggatctaaatcgtggagatatataagtcagttgctaccatcagcggtctagcctccctgaggctagtggatctaaattttgtatgtcatgaggacgtcgaaaatcataaaccagtctagcctccctgaggctagtggatctaaatattaagatgctttttcacaagtgtgttgtcatcgtctagcctccctgaggctagtggatctaaattaagcgttgtgttatagtcaaatgctcccgtcgttatgtctagcctccctgaggctagtgaatctaaatttattataagatttcccattatcctatgaaaaaatacgatttccttttgcctgacagtaacgcaagatcattacaggcttaagaacatcgtattttttaattcattttatttatccgctcttcttttcatatgtgcgctttagctgttccataaaaacagcaaggactgcaatatccgcaggattcacacctgaaatacgggaggcctgtcccatcgtcagaggctgtaccttattcagcttctgtcttgcctccagtgacagattcaccacctgattatagtcaaaccgctcaggcaggcataccttgtccatcgcccgcagatgttccgcatcacgcttggctttttttatgtatccctcgtagcgaatctcgatttccacaagcttcgcaatcgcaggatcaaattcgcgttccagataaggctctaaaagcgcgatggtaattcccggtcgcttcagcagctctgcagcactgatcccctccttcagcacatccagtcctagccgttccagcaatccattaactgttgattttggtgtaaaccgaacacttgcaagataggaaatcatttcttcgatattttgcattttcttctgatatcgtgcataacgctcatcgctgatcagacctgtctcatacccatattcgcttagtcttgcgtctgcattatcatgacgcagcagcagccgatattcagcacgggaagtaagcagacgatacggctcctttgtcccctttgtcaccagatcatcaatcatgacaccgatataggcttcatcacgatgcaggattaaaggttccttgtgatccagcttgcgaactgcattgattcctgccatcagcccctgtgccgcagcttcctcatatccactagtaccgttgatctgtccagcagtatataaattctcaatgattttattttccaaggtcggcttgcattgcagcggatctatggcatcatattcaatcgcataggcatatttttcaatagtgcagttttccagaccaggcagagaatgcagcatagcctcttgtacatcgtacggcatagaggtagagaagccctgtacgtaggtcgtatccagcgactcgctttccggctccagaaaaatctgatgacgctctttatccgcaaaacgtaccagcttatcctcaatactgggacaataacgcggtcccactcccttcaccaatccggaatacatggcagagcgtttcagattgctgttgataatgtcgtgcgtctttgccgtcgtgtaggtaagataacagacagcctgctgatcaaatggacgaatttcctttgtatcctcagagaagcagataaattcatccgttcccggctgtactgcggtttttgaaaaatcaatggacgccgttcgtacacgggcaggtgttccagttttcaatcgaaaggtttcaatccccagattacgaagactctgtgacaaattctccgttgttggctcatcctcaggaccgcttaaggtagaagtatgcccaaccagaaccgtactgctcataaatgtacccgttgtcataatcaaagcacgacagttcacaacggttccatccttttgacgaacgccgcttatcctgccatccttagccagcacctcttccacacacatttcacggatttccagatgctcctgttgtaatagcttgtcttgcatatagcgcttatattccagcttatccgattgtacgcgaagacactgaacacccggtcccttcgttgtattcagcattttaaactgcaatgcagtcgcatcggcagcttttcccatttcaccgccaagtgcgtcaatctctctcacgacgattccctttgcaggacctccaacactcggattgcatggcatggatgcaatcatatcaatatgcatagagtatagaattgtcgttttcttcaaacgggcacaggccaacgcagcctcaactcctgcatgacccccgccaattacgataacatcaaccatacgatttcctttcctaatgtcccttatagccacattttgcacaggtatttcccgatcccatcagggccccgcagtgtggacacatatgctcctttttacgtatttccttatcgaactcacttacaaattcccgctgaattcgttttcttctcatattcagacgaagcaggaaaattgctatgaatagcataattgcgcagacgagcagactgcatgcactcgtccagaatggatatgcttctatatatgaatagagtgcaaatatgccagctagcagtgctataagaatacagagcgcaaatgacagccagcgctgtttcaagctgagacgtgaattgttatatttcatgatgattccttccttcatttccaatgcatcccacagcctataatctcatgagaaacccaatcccgaatatgtcctcattcgggttatattatagaatattttcaaacgtatgaacagggatttttttatattttgcgtttgtattcgttctagtgagcactgtaagcgctccgttttaccgattcttctgcataaggtaatccttgtttccagaaaacagattttcttttattacacacagattttcgtatagattcaataggattcacttacgtattctgcttgcttactgcaattattagccagttgttttataagaaaatacagtccagattaagacattgaaaatcaacacatggaacttcatattatacatattaaaaaatagcagagatttgaatagtcctgtgcctgccatcgtactcaaagctgaatacactaattccaaaatacacttatagaaagcaaggaaaggcattgacttttcactcatttttttctatactttaggaactgagacagaaagcctttaagggctgaaaagagagtgtcgccggcaagcaagcactctctttttttacagaggtctgagacagaaggggtgtgcaagatttccacatgcaggataaggactgccacagaaatcgatcatttacttcactgcgttaccggcggctctgccgttcgatcatatagatcagcttcagaaacatcaggtacgctacgatctgatccgtatgtacttccccttcatttcagcacacatgtccttgtgtccatactgttacctccactattacatacggtttctttttttaaaactcctaaattttttgacatttctctgaaataacctatagttaattacaaaatcatcgtaccttttatagctgtagtacatccatcttttcatgaagttcctatacatcccctacgaccttaccgcatttgcgtactgattaaccacaggtgaaaaaatacgtatctgtggacaatttatgttcaagttaatcataagagtctagtgtaaggcattgaaaatcaacacatggaacttcataataaaaaaaataaatctgaatcgtcctgtgcctgccatcgtactcaaagctgaatacactaattccaaaatacacttatagaaagcaaggaaaggcattgactttttattcatttttttctatactttaggtactgagacagaaagcctttaaaggctgaaaagagagtgtagccgccaagcaagcactctcttttttacagaggtctgagacagaaggggtgtgcaagatttccacatgcaggataaggactgccacagaaattgatcatttacttcactgcgttaccggcggctctgccgttcgatcatatagatcagcgtcagaaacatcaggtacgctacgatctgatccgtatgtactcccccttcatttcagcacacatatccttgtgtccatactgttacctccactattacatacggtttctttttttaaaactcctaaattttttgacatttctctgaaataacctatagttaattataaaatcacacaatgctcctatagcggcagccctgaaatcttatctcctccactttatgcaattcatgtcattcctggaaataaacctcccttgccatatcaaatagaatgacatgagctccctgcagtgtcttgatgcagaagctttcatcaatttccacagcatcgcgcagctgtaagcaaatatcattacactccacctcaccttctataacaataagatatacctgacgggaaggctctaccggaatatccagctcctttctggaagataaagcactgacataaatatccatatcctgatggattttcacataagctgtattcttatgaccacttacgatatgcagcaaacggttttcgcgatcctcccatggaatgcgtgcttcaccatactgcggagtataaccgcttcgatcaggcaaaatccagatttgaagcagacgtaatatttcctccccgtcgtttttctcactgtggaaaactccggtacccgcactcatgtactgtatttccccacgtttcagtgttgatacattttgcatgctgtcggcgtgggtcagctccccctcaatcacataggttatgatttccatatcccgatgcggatgggtttcaaagccggtatgaggctgtatcgtatcatcattaactacccgcagcacaccgtaatgcatatttttcggattgtaatattccgcaaaggaaaagtgaaaccagctgtccagccagccgagacagcttcttcccattttgcggtgatcaatctttttcatcattgtatatacctccatatccagtatgtacatgtataacacttccatgcatacgcagttacactgaacatcactgagataagaaaaaactctcagatgccgcgtgattcataatacatgggctgctttttctggcatgcaccttatccggaacgttcgcatcttgttgtccgccatcatgatttataaacgctcttgtctgcggctatatgctgtaacagtcattccgcagtgctgtaccacaggcattcagacgaaaacagcaaaaagaaaggatactctttcaagtaccctcagtgttccatattcaaataaacaaacagcatccggtttttaccggacatatccttaagaacctcaattcttgcatttggaaaatatttcttcgcctcttcacttagcgcttccttctggttatagcccatttcaaacgccatcatagcacgttccttcaacacctttgcggcattttcaaagataatgcgatagaatttcaagccgtcctctcctccaaatagtgccacgtgcggttcatagtccacaacactgtgctccatttcctcctcacgcggtatgtagggaggattactaattagaatatccaccttcagattgcggtcaatcagcggctgtaacatatctccaaccatgaaattgacgattgcttcattgtcatcagcattctttttcgcaacagctacagcctgttcactgatatccgttgccatcatatgcagattcggttcttcctttttcaaagaaaccgcaatcgccccgctgccggttccaatatccaccgccatcacattatcctgactggaaaaatgctcatcataggctgccagaatatttgcgaccagctcttccgtttccgggcgcggaatcaaaacatcctcattcacggtaaagcgatagccgtaaaaccattcaaaaccaagaacatgtccgagaggaattccggtgagaaggcgctgaataccttcttcatagagttcttccagctccggctgcatttcctcatcgaattccatatacagattgtgcgcttctttattcgtcagctccagcatatacagcagggcagactgttcgccatagccggcttcctccatacgcgcctgagcattcttcagcacggaatgatagctgctcattatttctcccctgccagctttgcctgctgatccgcactcagtaatgcatccagcagatcctgcattctgccttccataatgcgatccagctgattcacggtatatccgatacgatgatcagttacacgattctgcggataattataagtacggattttttctgcacgatctccggtgccgatcttgttccggcgttcgataccctgctcttcttccagcttgcgctgatgctcctcatacacacgggaacggattgtcatcaatgcagttgcacggttttcatgctgtgaacgtccgtcctgacacttaaccgtaattccggtaggcttatgcacaatacgaactgcggaatcggtcttattgatatgctgacctccggctccgctggcgcgcatggtttccatttccagatcgttcatatcaatatcaaaatcctccggttcgatttccggtgttaccagaacggttgctgtagaggtatggatacgcccctgactttctgtcttgggaacgcgctgtacacgatgacttccggattcaaacttcagttttccataaacgccgtcccccctgaccataaaggagacaagggagaagccgcctgcttcacagtcatccatttctacgatttctatcttccagccctgactctctgcaaatttgctgtacatccggtacaggtcacctgcgaagatatttccttcatctccaccggctgccccgcggatctccacgatggcattatgagaatcattgggatcctttggtatcagtagaatttccagcttttccagatattcctcaatcttaggctccagctcctcgatttccattttcgccatttccttgatttccttgtcatcctccagcaaaagcgccttggcatcctccagagcactcacactgtttttatattccgtataggtttccaccacctgagtcagatcggcctgctcacgtcccagcttggccagcatcctgctgtcggttacgatttccggtgacatcatcatttcattgatttcatgataacggttcaccattccttcaaggcgttctatcattacactcatactatacctcctacgagttctttctctcattatgcctgaaaaacgcataaatatccttatatactatatcattgaacggctgaattgcaaagaataaaatgtaggaatagatgctttcccttcgaatatatgcgttgctgagtgaatgagagcaatcgtaaaaaatacggcaagtgcttttgcaagtgctgcagatgataccatgagatacccgatcacgaagagaaaccttaaaatccgttaacagcttttccttgtcaattcacagacaagcacgaaataccgttacgccttcggttaaagcacaggttatcaatcacttcataaacagctctttgcggctgtgaacctttactttgcgatatagccttttcatatacgatgcgaccgtattctcctttaatccgctggcctcagccatctcccttcgactatatccctttaacacatagtttaccagctccagctctctttctgtcagcccatagctgttataatcgcgatgctcctccagcagctgtttcagctttctccatctccagctgtcgctgcatgaaagaaatacatcctttccaatttccagtatgactgccatgatgccatccggctggcagatttcgattatgtgatgaacagcctctacgatctgttcctgatgattttcctcctccagcaatatgcaatagaacaacagcgcatatatcgttccaaacatctgctttctttcatgcgcctgactttccagcagggatgccacaacacgcagctttgcataattacgaatcttcatcagatacatgccgtaaacaatagaagaatacagggtagctccctgaagcagatttccttttctcccctcctggatccattcagcaactttttcatattcaccggataaaatatataaataggcctgtgcaagatcgatttccgaaagaagcggcggcaggatcaccttttcccggagagcagccagctgttgatgaacaaattgcagtaatgtatgatcacgaagatgatatgcggctcttccaattgtaaacagcgaggatacacagatccatttctgacggtaatgctcggcaatgtagtatgcttcccatgctgtatgtatgctttccgcaaagcgggcgctttccagctgctgttcagcggatgactgttccattaaaccaccatttgagttattggtaatttcaaagtagtaatgcaggtccttatgtaggatattgacgattctctggatatctcccggttttcgatgatataaaaacagattgtgcggactgccgaaggttgatatgatttccggattgctgattcgtgaggtctgattacgcagcagagtttttgaccgcttaaaatagcggctcatctcatgtagattgttatagcgggaatatgccagaatcagctccacctccccctgcagcagcttctcatcctcatgcaggcttccgctatgcagcgcatgtagaaagccctccagcagctgctttccataaaatatatcctgcagattattgaaattatccataatagcatgcagccatgcatatggataatccacgtacagctccattggtaccatctgatagatattccgcattaactcagtatcataatctgcaaagtttttgctttcgtataattccagcagctgcagtatttttttataatccttcaaaagataaagctgacgcagacaattgaggatatcaccgctgctttcgtaataatcggcaattttgcgatagagatgactcggatttttttcatacataaggaatttatcatacaggaactcacgaaatacaggagagtaggtaaagaggcgtgtagttctgtccacctgcacaaaccagtggaaattcatcatccaggtcaatattttcatgattccggtatccacgcataaagcctcaatgagctggatattaaagtgctcgggaacagacagcacagccagactctgccgctgtgcctgattcagctgccggtatatatatacgtcaaacaacggatacagctgcaaatccggattcaaagtgcgtacggctccatattcctccagcagtgcatgcacaccgatggtccatccgcaggtaactcttagaatttcccgcacttcccgttcatcaatgcaaatctgattcacagctgccagcttctgaatatcggcaaactgaaatcgcagcattgtcgtagggatcagcagcgtccatctataaagctctgaattaaaaaaagagggaattcctgatgcaagaagtataatcctgcagctatgttccctccgttcgtacaccttcatgatatgtctgtccagtatatgattgcgatattgatccagtatgatgatatcatagctgccgctatctatacttttctcaaaaattcccccaagctgtttacgatttttcttatgcatatgaatccagcagcacctttcctttcgattatgcagaaaggcagcaactgctgttgtcttgccaaagccatccggtccgtaaatgcaaatcagcggataggaaaccatatgcttcagcattgaattaaattgttttctggcaatctgtctcatattccttcacctataccattatagcgtatattacaaggaattcaaaagtgaattattaccattttatgtatatcccaaaaaaatctacagctcctgaattacgcagaagcccccatgtattgtaacagtattttttacatccattttctgcctgaatatcagatacaggatatgcctgcttcaaatcccatacatcaatcagatgaggaccgcatgcagcacctcttcaaatatttgtgaagcagaatactttcactatagttgtttcatggcagccatcgcagtgctccgccatttcgtttttgtatcgtaagaaattcattcatcccctttcttaaacaaacgctgtataagcgttatcacaaattgaaaaacagcggctcccacatcaccgggaaccgctgtacagctaacgaatagagaaatagataccaaatacgagagagatgaagagtatcagtacaagtgctgttacaatcagtacagacagctgtccttcttttcttatttccttcagtgcattctttacagaaaaggtattccactgaaaatattttctcagtgatagcatcatcaggactgccgagatgaagttcatcagaatgaattgtccaatcgtcatcagcagcagatttacacgtatgctttccacatgctgaggaaccgcaagatccttcagaaaatgcttcagtacataccagacatacagattggccgtacagatcataaagccggtaatcacgatcggacttttactgatcagctcttcgtaggatttaccgctcaggtttgacagaccgcctacatataccagaaacaatacgaccatggcaacacacgcatacttcgcataccggatataacggaaaccgcctgtttttgcgagcttgtttttctgtcggataagatctcttcttttcatactgactcctcctgcaatggttgccattttctcatctcctctattatggttagtctaaatgcagataatcctttacttttgttgtaatatttactacacgaacaccatatattacctgaacagagttctttccgcgtacaacgccgatagcctccagataatttttccagcttgtatccggtgcaatcagggaatcatccttgactgtaacacgaagacggctggcacagcaggttacggtttcaatattgtccgctcccccaagagcttcaataatacgaacctcgagtgcatcctcaggtgcggaagagacattcgcttcgtccttaccgctgtttttgatttcattgtattcttttttgctcatcagcttgatttcaccctcgtcatcacgaccaggtgttttgaggttgaatttcgtaattgcgaatttgaatgcaaagtagtatacgataaaggttacaggaagcagccacaatgcgctcatggcatgtaccttctgcggctggaacaggtttggaatcatgaagaacagcgcagttccattgatggaaatatttgtgatttccgctgcgacatagcacagaccgcacaatggagcgtataccagccagtacagtgcaggtgcaacaaacaggaaggtatactcaatcggttctgaaataccaaccattgccagcgtgaagacagacggcaccagcagtgatgctaccttcttcttattttccggttttgcacagcgatacatagcaaacgcggcacccggcagaccagccagctggaacagcagacgtccgttggtgaagtttcttgtgatatagccggttgcacttgcgcttgcagcctgaccgttgataatgtttttaacaccctcatacatcacaccgtcgatcatcatcgtaccgccgacctttgtatattcgatcgggaatgcaatcagatggtgaataccgaatggcagcagcatcttatccagtgtaccgaacacgaaggttcccagcagaccacttgtacggatgaagccggtgatactctgcagagcacctgcgacatacggccatacataatagaatgcgattgccagtggaatagaagcaagagcgaccataataataacgaattttgttcctgcgaagaatccgaacattgccggcagctttgtatcaacgaatttgttgtgcagtcctgcagcaatcagaccggtaacaataccggagaagattcccatgttgtatgaataaatccccaaagagcttgaccataaagcattgaagttcaaggcagcctgctgtgtataaccgctttttaccagtgcgtcaacagtcgtggtttcagcggtccatccttccagcgcagcccagccttcaattcctctcataaagcagaagaataagatcagtcccgcaaatgctgcccatcctttctccttcttggcaagagtgaaggcaattgccacggcgaaccatagctgcagattgttcataaacatgaatcccagattggtgatcatggtgaacagattgtacaggatgtttccttccggcaggatgtagtttgtaaatgcactaccgatacccacgaagaaaccaacgagcacaagcaggatgattggaaccatcattgccccggcaaatgtctgaagttttgcctgaatgtttttcatagcttgttcctcctttgtttacgctttcattttagcatgtccgccaatttgaaaaagaatgcaatgagttacggtaattcattattattgtggtaatttttcatcacctttttgtacatgccagttccacaagtgcctcatagtagatgtcactcgcttttaacagcgacttcacaggcatacattcgttgggcatatgagggcggggatcctcatcaggaaaggtcgcaccaaatgccaccccgtgctccagaacgcgggcataggaggctccccccttggtaaacaccgcagcatcttccttcataaccctgtgatatgctgttttcagactctgaatcaaagtgctgtcctctgcgacgtagagcagacgcttatggcgtaaaacctcaagctcacagccataatgctgtgccgttttgcgtaaagtatgaagaaggctttgctcatccgttgaccgcacataacgcacatcgacacacagctccagctgtccatcctgcgtattcagcgacatcaaacaaacagagccgcagcccatggcagcatcctcatgatacaaaccgcttttcttaccgtaaaaatcatcaagaaaattctcgtatatcatattcaccatcggatacagagagcctgcttgatcgaggtgtccgtgaaaatccttaacaaatttgaaaatagcattatccccgcgctgcggattgcgggaaagtgcacgtacaccacgataggtgatttttatgccatcttgcataacctcaatcagattggtacgctcaacaaagctgacatcactgcccttgggaacaatcacctgtaaatcatcacagacgatatgcagacgctccttgcagtgcaggctgatatccgaatctgcattcagcaggaagcgtacctgcaaaatccccttttctccattgacaataggaaagttgccatccggtgaaaagccgaagattggttgcgggttatgcttgaaataatgctccatgcattcccatgttgtttcctcagcccctccggcaatgaggcggatcggatgatacagtgtacgaccttcctgcctgatacgggccattgcatataaagctgccagcagcggtcccttgtcatcattgactccccggccgtacagcataccgtctatctcctgcatttgaaagggatcgccgtgccagtgagagcgttctcctgcttccaccacatccagatgagccagcacgccgatataatcatctccctcaccaagttgggcatctacagcatagccgtcaaaatcatggacgctaaagccctcccgctgagcaatctgcaggaaaacatccattgcattccgtatctctttgccaaacggggcagatgaacctgcagtgcgctcatcacggacggaaggaatttccaccagctgctttaaatcctgcagcagctcactcgttctttttcctgtatcatagatagttttcattatgttatacctccttatatggttataaattccacatgaaattgccgctgtcattcttgacagaacagcgtttcacacgtatagttgcaagtgaaagcgagggtgcacgcttatgaataaacgaatcatgaaaattgtggatgttctgttgaagcaggactcctatatcacgattgataaaatctccgaagagcttgccgtatccaacaagacgattcgcaatgacctccagatcgtggatcagtatctcgaggaaaacaacctcaagctgattaaaaaaaccggcgtcggtatccgtattgacggtaaagtcagggacaagctgcacgtattggaaagtgtacgggagaaaaataaaacgcttgccgattattccccacaggcacgtaaaatttttatcgggatgcagctgagtgcctttgacagctgccgcatctatgagctgagtgaacagctgtttgtatcccgtgccaccattcacaaggacattctctccttgacaaaggatctggaaaccttcaaaatcgcattgcatcgcaagaacaacaacggaatcagtatggaaggcaaggaaaagaatatacgtaattttctgctggagctgatgctgcgtgacaatggctatcaaatgtttattgatatcatacggcgggatgattaccgctgtgacggctcctatgtatttcccgggctggaggttaccgatgacgaggtcaaggactttaccggctgtattctccgctggggcaatccgtatatcaattccctgacctttccctccatggtgcttgtcctgctgcgagcatttgtcacctatctgcgcattcaagatcgccatattgtccatctttcgacttccttcatcgaggatttgcgaaaggagccattctataaagaagcacgcgagctgtgcgaccggctggccaatcattaccggctgcagattccggatgtggaaatacgctatctgcaggtctattttctcgccctgcaaaacagccgcgatctcagtgaacaggaacaacaggaagcgcgtatgctgagtgatgctctgcttacctcctggagcgaacagctgcatctgccctttgaccgggatgaagcactgtgccagtctgtatatgaccacctgtgtcctgccattatccgttttcgtcacggcatccccaatgaaaacccgttgatgcaggaaatacatacgctttatgaacgtacctttcaggtggcaagaaacagcgtttccgttatagaagagcatttccactgtaatgtgagtgacgatgaggtcggctttctcgccttacacttggcagcctctttggaaaatatgaagcagccgctgaaaaccatattagttgctcacggcggtgtgggagccggaaatctgctgcgtagaaagctcagtgcccagataccggaaatcgacatcatctcccaggaaaccttcttttccatttatgagtgcgatatcagtgatattgatctgatcatcagcacactggagctcaatctgcatacagatgtcaccatactgcaggtcaattccctgctgcatgactacgacattctgcgcctaaaggatgtgattcgcgaatattacaaggtgaaaaacgatccttataattttaaatcggcagcacaggaataaatcatattcccttgcccgcaggagcttatgcataggaagcacagaaacgatatcctctgttttcaggtgcatttccgatgaaacgaaaaagccctgtaaacgctaaatggaatacagcacaagggctgtacagctgttgaataacactatctgtgtaaatgaaaatcgggaagctgtgattctattgatatacaataaaatcatacttccctttttatgtcccctgaagtgataccgtctacaagccgccacgcttttatggcagtgtataggttactgcgacgctttctccacccttaacttcgacaggctcctctctgcggaattccgcatagctgtctttatttgtgaaaatgacgataacactcagatcatatccctttgataacagatattcacgatccattttcaacagcggctcaccttttttcacgtgcttcccctgctcacacagacaggtgaagccgtttccgttttcgtttaccgtatcgattccgacatgaatcagaatttccataccgtttttcaaagtaagaccgactgcgtggttgctgggaaacagcatggttatatctgcatcggcacatgcatatacggtatcacctgtagaagcgatggcaaagccgtctcccatcatcttctgagaaaatacaggatcctttacatcttcaatcggaatcagtgttccgtccacaacagcaagaagctcctccctgctcttttctttctttctaaatccgaacatatgtcatacctcctgatgaaatatttattacaagtatatcttacctgtttcctgcatgtattacaatcatttcactgttattttcgcagccttttctatgtggtaatttcttacagcaatgtttataaattgccttattgatacggatggcgtttccacatcctgcgattgcggaagttcagcgaagtagcgtacaataagggtgcgaaaagaaggaggaacttacttatgaaacatatcaaaattgcagctggtcttgcacacgttaattatggaagaattgcggatctggttaaggaagtcagtgatgccggagttgactatattcactctgacgcagctgacatgcacgatcttcaaaacatgaagctgatgggtggtcatcagattatcgcgggtattcgtccggagacagacaagccgatcgaatgtcacatttatacagttagtatggacagaatgttcatcgaacagattgacgaggcgggagcagatatgctgatcattcctgcggagcactttatcggcgcacaactggcttatatcatcaactggtgccgtgaacgccacatcaaggttggtctgacactgggctgctatacaccgttatgcttcgttgaggaaagcatttatgatattgaccgtttgcacatcgtaacacacggtgtagatgaaaccgatggaaaagacaactggggatggagaaagagtgccattgatcttgtacagcgtgcacgcaagatgattgacgagaaaaatccaaaatgtgagctggcggttgacggtggtcttcgtgccgataatatggacaagctgattgaatgcaatccggatgtcatcgttctgtccagtgctattttcaaggatccagatggagcagcagctggtgtgaagaaatgcagagccgcaatcgatgcagcagcagaaaaatacggtcttgaataatacaaagaactctcccgctgagagttcttttaaagaaagctccatcctgacactggtgaaggattacggatggatcacgtttgctgctgccattaccgctgttgcggttaatttcttcttcacctcgaccggactggcaccagggggtattacggggctttctctggtttgctccaccgtattcggtattccggtttccacgatgtctctttgtatctccataccgctgctgatcttatccaccatcgtactggggaaaagctttggtatcaaaacgttgtatattacactggcaacaccgctgtttatgaaattaattccctccattcatacaacacagttccttctggatatccatccgcttctggaattggcggttgccggtcttctcgggggactgctggttggggctgccatcggtatcgccttaaaccacgcctgtgcaaccggaggtacggatgtcatagcgctgttgattcagtatgtttttaaattcctaaaggtcagtgtgattctgttcttcctggatggctctgttgtgattgcctccggtgtgattacacagaatgcattgatctccgtattcagcttcctgtctctgatggtcatcatccagacgatcagctttgtgacaaagcataagctgagtgcgtgaactaccgccagctaaagagcaggggcttctaatgaatgcttacacatccatcaaaacgttttgttcgtgttcagatacacgtaactggcacgttcaccgtacctctactccatcgctctcgctctggcatacatggatatacttttcgtatgatattgcttgctccattgatatcggcattcattagaatgccgtttttgcttctgtacaatcctcgcttgattcttttccctgtgaaggtgtgtgttacatcgtttccatagactggtatttgatcctcgtcaatggaactagccttcgattgtattgcttcttcacagaccacgactctgattcctgccgcttctcctttgtatttgatcatttcgatcagcgtatgaaacggtatctgaacaaatgtctgattgttcttcttccccatatggatacgcttcttccaacccgcatgattccctacgacgataacttcgattccttccttcacacatagatctattatttttcttgatgctttgtgcaggatatcctttacacgtcgatttcgcttttcgctgatacgtttcattcgttttgtttgatggatgcctttgctatccttctttccagttcttagcagtgagcgataatgtgcgatctgtttgttaaagtattgattgactgcttttatttcatttccttttatcagcacagggcggtgtccgctcgtaaacgcaattgctgtcagattatcgacaccaatatctatgccggctactcttctatatctgtataaagcagccgatattctttaaactacgtaattttataacctgtaatgtatggctgatataagatgtgactatggactgcttgacattctccagaatacttttacactaagagtaagaatttgtcacaatgtgcacacacttccgtctaattataggaagagtaaaggaggctgatattatgcagcaggaggaattaaacaaacgaattgatcaggcggttcagggggatcgccttgcactggaggaggttctgacagaaatacaggatatggtattcaatctgtcactgcgtatgctgggaaccatagcggatgcacaggatgccgctcaggaaatcctcattaaggttatgaccagtatttccacctttcgcaaagaaagcagatttcaaacctgggtgtatcgtatcgctgtgaattatctgatggatgtaaaaagaagcatgttcgcagcgcatcccctggattttgatttttatgcaaatgatctgcgggcaagctatgtgccggatgaagaagaagccctgacgggatgtacgagggaggaggccgcaagagagctgaagctctcctgtaccaatgtcatgctgcaatgcctgaagccgcaggatcgctgcatttacattctcgggactatgtttcacattgacagtaaaagtgccgcagaaattctggatatgactcctgaagcataccggcagcgcttatctcgggcaagaaagcgcatggcttcttttttaagcacctattgcggagcagtatccaatggattctgtcagtgtgataagcggattccctacgcagttatgacacaccgtcttgagccgcagaatctggaatacagcagactgaaaacactggataagcggattctgaataaattctgtgatcatatggaggagctggaggagattatggacagcttcgatcagctgcctgcctttcgctgtacaatggacgccaaacagctgttaagggagctggtggattcagaggtcatgaaaaaggtacagaatgcaaaggaggtggcctgatatgtctattatgatggaatacttgcgccagctacagaaaaacaaccagcgggactggtttcaaagtcacaaggagctgcggaaggaagcagaagcggagtttgaggagcttttacaggagctgatggagcgcattgcatgcttcgattcctccattaacggctttgcgccgaaagagctgaccttcaaacaggtgcgcgacacccgtttcagtaaagataaaactccgtatctgcctgcatttcgcgcacatatttccgcaaaggggaagcttcccataccggttggatattatattcatctaatgccggataatcaaagctttctgggaggaggattgttcgcggatatgttcaaggacgcaacagccatgatgcgtgatgcgattgccgcaaagccggaagagttttccgccattatcgaagctccttcgtttaaggatcacttcacaattacagggacaaagctgaagcgtgttcccaaggggtatgatcctgaccacagcatggcctcctatctctgccacaaaagctggtgtcttgaatatccgctcatggataatgaggtggaagaccgcgagaagtttctcacactggcctgcaccctgtttcatgcaatgaagccgtttcatgattttatgaatacggcattgcaggattttcagttcccgcagcgatagagatatgtatggatatcagaaagaaacatgcttatagatggctatggaaaggtgctgctgtcatgatgctgtatatatgacattgcactcattcatttttcacagcatacatatctgtgcaagacgaagctgtaaatgactttataaatgatactacagaataagcagaagctcccattttacatggatgcctctgcttattttgcctgcatgctgactttatgacagtctacctctacagctgttttcgcaaatgctgagttttatctatttccccatgaaactgcgcaagcattttttcccatgccgcatgcaaattatcgtccagctgaaacagaccggaatttcccacgatgaatacttccacccctgcctgacgcagctcctgaaaggttgctgcattgcaggagccatccacttcgattagataccgatagccatgctgcagcttaagcgccttcgcttcttttatcttatccagcatttcgcgaataaaagcctgtccggcaaagcccggatcaacactcataatggtgattttgtcaagtaaatgaagataatgccggatataggacaggggagttgccggattcaaaacaataccggtcctgcatccaagctcatgaatcttatgaagaatacgaaaggcatccgtgttgatggtttctgcatgcggcgaaagaaaggtggctcctgcctgggcaagcatggtgatatagtcatccggatgcgttaccattaaatgacagtccagcggtaccctgctgacgcgggctactgctttgacaaaatccggagataatgtaatattctttacgaaatgaccatccataatgtcaatatgataaaaatccgcatgcagattcagaacttgaatctgttctctgattttcaataaatccatacacatgagagacggactgaacataggcttcatacgtatatccccttcaagtaaacgtttacgtatcctctttttttaaagctcacctacgtgagctcaggttgattcccttacacaaagagaaaccggtatgataaattcctgcttatccagctcatgatgaatccgcttcaacagcgcgtctcctgccgcctccgccatcagctctgtattttgtgtaatcgtagtcagtgccgggtgacagaactgtgaaatggagacattgtcaaagccgacgattttcacctgatcgggaacctgaatatgctgtgcatgcaatgcgtgcagacaggccagtgccatattgtcattggtcgcaaacacgccgtcaaagaagcagcctttctgcataagcaggttagtgactgttttgaatacactggcataatcgcttttcgtcatgatttcccaggattcctgaaatgctatccccgcttcttccagcgcttccaggtagccgcttcttctctgccgaatcgtggacgctttcttctgatctcttaaaaacagaatgctgcggcactgcttttcgatcaattctctggcagcaagatatcctccctgccgattatcggaatgtacaaagatgtgcacatcctccggctttcggtcaatatagacgatcggtatggaaaatgcggattcctgtatcggatttgcattccttcctgagatataaatgataccctctacctgctgctccttcagattgcggatatgcagctgttcgatttcaatatcctcatgggaatcacatatcaaaacagaatactgatgtttgagaaagaacagttccaggtaacggatgattctcgcaaaaaattcattggtgatatccggtacgataacaccgatattcctgcttttctgcgtccgcaagccctgtgcatttttattaagctgaaaaccgcattccgcaatgactctgcgcacacgggtctccgtttccttggaataaccgcccttttcatgcagcacacgggaaactgtagcggtggacacctgcgccagacgtgcgatatcaataatattatatttatgctgttccacatcgacacctcctttacgtaaacgtttaactaacacatgtatatcatagctaaaataatagtggatgtcaatacagaagcagcaggagaatgacgaaagtacaccgccattatgctatgcggacatatcataaggaaaaccgttatataagagatcatataaacaagggaagaaatgagagcgtgcaatattgaggcgtgtttatttcacagcagtatagccgtcgggataacaaaatagacctgacagacaggattcatcattttcagcaatatgattaaccatagaatatccctgtctggttttatttcttgggctgttttacatgcagtgttttctatacgaaaaacagtgccatcaattctttttaaatggacagtccgtatcatcatgagagcaaaaaggaatcagtgcatcaccaaggatgaaactaatccttttgtctttgatgaaaaacaaggtaaataagaaccggaaattgacaataatacggtcatggattttgatggttaaatctattgcacaaagcaggagctgattacagttaacacattatacctactcccgctattgtgtgtagttcagctcctctttctctgcatatgcccggtatcctttatgcagacagcatgcattgttctgctttccaagcaaagacagtatattacatgaagcagacatatcacagctgccatcagtatcagtaaattcaggcttatcatgaaccatgccaggaaaaagagaagcaatgcaaaagagaaggcatgcagctttatgcttacctcaataacagcgcacctcttccagtaggaacggctgtgtgtgtcacatttgcgaaagataaattgcaaaagccgatctgcacccttccggtattgcatcagcatcagctgtcccggagtgaatttcagattgggaaacagcttgctcaaaaccatttcctgatgcagcttacgccgcatgcataccggaaggagaatccataatccgatgatgacactcagacagaacagcaatatcaacggccacagaatggcaaacgccgcactccacgctttaccattcaacatacagaagatgataaaaacaggaacaagtcgcttcgtaacattgataatcgtgatggtccccatggctgccagatagccctgtgaggttttatagcagccgtaaagaaagcctgtcagatacagcagctgtatacagagcagaaaggtgagaaaaggcgatgcgattgttttctgtatcactgcataaacaccaataccgatagcagcggcaggaagctggaacagcaatagtgtacacaatttgcagagatagcttttacggcaggtaaggggaaaagccagaagcacctgccaggaaagcgatggttcttcttcccatgcaatctgataaacaatgctgagaaacagaaaggataccaagcatgctgcagcctgtatctgctgatcctgatatatactgccctctgtcaccgtaaagctgcttaccccactgatgtagatataggcaagcaaagcggcaggaatcagatacttccattttcggttgcgaagcatacgaagcagctcatagcgaatcatacagcatcctcctccggctggaaatattgcatgattttcctatggtctttcgtatccagaaccagatggtgaccatccagtgccagcagccgattcacaacaggcaaaatgccggatgaggtatgactggtaatcaggaataccgtgttctcacacttttttgaaatcagctcacacagaccttcactgcttttcgcatctatggcaacaaacggctcatccatgataatcatatccgcattgctgagcagaatacaggcaatacccgccttctgttcctgtccggagctgcactggtccatgcgctggtttagataatcaatcgacagtgcctgcagaatctcctgtacagctgtgtcctgcacatccagatttttgccatgaaagcagcggtaaaaatatcgcagattttccaatacggttaaatggcgatacagaggatgttcatatggcagatatccaattgtcattccaccacgtgaaaggctcccgtaatccggcggcagaaatccgcagaccacatttaacagtgtgctctttcctgctccgtttttcccggtcagcagtatacacccgtctccctgctgtatcgtcaggttcaaatcctctaaaatccattccgtatcataggcatagcctaccttattcagtgtgatctgtttcattgcacactctcctttttgtatacagggtacgtaccctccgtatccccatataaagcaaatagttcagtggactttccagacaggaggaagctttcccaataacataaaacacatgaactagcagcatggcaccaatcacggcatataacatatttccattatcaagcagaagcgtcgcaagcatgacctccacaacaataaatgaagaaacattgcgcttatcgggctgcggttcctgaacctcttcccatgcttcctccatttcccgatccgcagactgaagcagctctgtatgttcttcctccagtaaggctgcaattctttgcatataaagattttgcagctcacactgcgcaagctttttctccagctgttccttctgcatatccagcagctgcatatttttctcctgcagcagttgttcgatatccgcaagcgaaacatccattcttcgcaatatttttatccgcattagaatacggacatgctcctgtgtgtaacagcgatagccgttctcatcccgtataacctgcagcaatccctttttctcatacagattgattgcttttttacttaatccggttgtatccgcaatctcctgaattctcatattctatcacctcatgtttgaggctattgtacagcagtccccaggggaacggtcaatagcttatgcttaatttatacaaatttaataaagtttgcctgaataattacagaaaacaggcataacaccaatagacagagcggcatcatgcaagaatacaaaaatgtctgtaaaagaatcatctcttacagacaactatgtgtttctcttataataccagagaaggtgcgctgtatgcacggccagccatttcattatccagcatgtacaaactcttaggatctgtgccgaataattcgaatttcttcaccatatcctctgcattcttttcttcctcaccctgttcctttacaaaccagtccagaaactgcatcgtgcgatagtccttcacctcatgtgcagcatcataaattgtatgaatcaggctggttacatagcgctcatgctccaacgcaaattccagcggatcctttaaggcactgcatactttatccggcttatccacctgtttcagtgtgatgtgttccccgttattctgcaaatactgcagaagcagcattgcatgatcgcgttcctcctgcgtctgaatcatgtaccagttggcaaagccatccagcccctgctcctgataatagagagagaaatcaagatacagatatgcggagtacagctccttgttaatctgatcattcagcaattcggatacttttttatcaagcataatcatacctcctgtgtcttatagtataagtatactctgtatggtttgaatccggaagtaccttttacatttttttacaatttgtgacagctgtatgactactcctttgcgcgctccaccttcagctttttgcccttgatggttttctgacgcagcgcacgcagcacctgcaagcccttaccatgcagtatatccacataggactgatgatcctgtacctggatgacgccgatatcatccccgcagaccccttctatttcgcaaatggcaccaacgatatccccggggcggattttctttgtcttccctccgccaagatacagcttcatcatatccttgcgcagctccttccctttttcctctttttgagatttcggaattcccagctttctcaatgtctcagcgtccgcaataacagcttcaagctcactgctgtcatgaaactccagtgcattccccagatattcttccagctcctgaaggcggaaatcatcatattgtgaaacaaaggatatcgcggtaccgcttcgatccagtcttgcagaacggccgatacggtgtatgtaggtctcttttttatttggcatatcgtaattgataatatgcgtaacatcctgtatatcaatgcctcttgcggcaacatccgtagcggttagaatacgaagcttccctaaacgaaagtccttcatattttccagtcgatcctcctgcagcataccgccgtgcagctgatcgacactgatgcccttatcatacagcatacggcatatttcgcgaacatgctcctgtgtctttgcgaagatgatacaggattcgggaagctccctgcataacagcttcagcagtgcctgcggcttttcgtgttccttcaaacggtatgcataatgatgcatctgctcactgacggaggtctgcgactcgatttccacaacttccgcctgcttcagaaagtcatgtgcaagctcctgtatttcctgtggcagtgttgcggagaacatgcagacagacgcgttttttggaagacgaaagaatatcttctggacagtttcgataaaccccatattcagcatttcatccgcttcatcgataatgatatagcggattttttctgttcgaagggttccctgctccagatggtcaagcactcttcccggtgttcctgcgacaacatgggtccgctgctttacatcctgtgcctgaaaacggaaaggctgcttcccgaatacggcagccgtcttaatgcgcttataggcaccgatgttatcaaattctcccttgatctgcagggcaagctctctggtcggactcagtaccaaagcctgaggtgagcgttcctcccagatcaggtcctgtatgataggtatcgcaaaggatgcggtctttccacttccagttctggatttcaccagaatatccttcttttccagcatgagcggtatgacagcctcctgtaccggcagcggactttgatagcccagtgtatgcagagcctcacagatggaggcatccagcttataatcttcaaatttcatgtttatcacctatatgtttcagctttcctacctattatacgggataacgtatggaaacgcaaagacagtctgcaggaaatattacaaaactgtaatcttgctgtaagcagaaacacacgacaaaccagtgtgcatacgatataatgcagatagaaagaaggaggagatggagatgaaaaagctgttgagctggattggcactgcactctgtttggcattctttggatatcacgcctgaacatctgatttgacatctttcctttttcattgcaataggcgccaagaggcgcttttttatcgcttacctgttttcagccttaatcaaatgaaacaacaaccacggcagctatgtaaaaggagaatggctgcggatactcatgttgcttttctgattctgaatgaaatgcacaggattttatataggatgtaaggaacagtatgattattggtatttgcttaacaataaaatcagaatatgatgttgtctgtatgcgacgttatacagaacgaaataaacgattagcctgtcaatcagctaacaggattgtaagcaaagtgtaagtaaattcacacgacgaagcaaagtgcttccggtatactataggtgtaagacaggagggacgctaccatgaaaaaattcatagaaattgcagaagctatcgcatgtatcctgtttctgggataccgtgaggaaaactttatccgataacttcccacagcagtatcgcgctgtgtaatatagatcaggcaccctgctgttgcatgggtgccctttatatttcttttacagtttcttctgaaggctgtatcttttctgtttctgtaagaatcgcggagtgctcccagcgatgtctgagataaatggcttgtgccagtatacattcaaagatattgctgagcagcattgccagccatattcctgtaatgccaaggctcgtaaagcgatgaaacagcagaatcatcggaatgcggaatgcccaaagacgcatcatggataagataaaggtataattcgtatgaccggagccattgaacacaccatcattcaggttgatataccatcccatgaaaacaccgcacagcaaggcaaagaatgcatattcctgtgttagctccataagctgcgtagatgcgtttggtacaaacaagtgtataaacggtgtgattacgagcattccgataatggtcagagtagatgagaaaagtgttgacagcttcatcgctgtatgaaatgcctttcgtgcacgctctgtattgcccgcccccagattctgaccgacaaaggttgccagtacagctccgatcgacatgacgggaatataggcaagcgtcaccatttttgcgccgacaccgtatgccgatatggcaacagcaccatagtagacgatatatttgttcatgatgacaaagcccagattttcaagaaactgaccgcttgcggcaggtatacaaagcttcagtatgatttttccatccgctgcatgaaacggatatgcccgaaaatcgatatgtacaggaaaggctttatcatgcagacgccgccatgcaaccggtaccataaccagcttggatacaaccgtggcaatcgcagcaccaaggataccgaagtgaaaaacaaaaatgaatatcggatccagaatagcattcagcagggaagcgcacatattcagctttacaccggatcggctgtcccccgcactctgtcgcattgccatatagaggttcagcataagaaggccgatatagtcaaaggaaattccgaacagatattgataactggcatcataaatttccttcggggtatccagccagcttagaatcggatgcagcagaagcagtgttcctatgctcagtacaatggcaaagcctatcgcaaagtatagaagagcagtagcgaaacgacaggcatcccccttttgattggccccaagccgtgtggatagtaaagcaatcgcagccgcactaagccccatggcaacactttgtgcacaccacataataggaccgacaagcgaaacggcgccaacctgaagctcaccaagctgtccgacccagaaggtatcaatgatattgtagagggagttgaccagattcagcacgaacagcggtacagccatgcgcagcaatgcctttgtcagatttccctgtaatatacccttttcctgcatcggtatctcccctttctgtattgttatatcatagcatattttctacccttcgcctatagatatagaggggtgaaaaaataagaagacggtgtgtttcattctttttcataaataaatgttaaacagtatgctgcatgtgatatccttataatgcgaggtgagtatatgaaaaagggttatagaaataagataacggatgttaaaggcgtccgtgtcggacataaaacaatagcggcggataacgtacagaccggtgttacggtaatcctgccgacagagggtgatatttttcgtgagaagctgacagcttcatgccatgtgatcaatggctttggaaagaccggcggattgatacagctggaggagcttggtgtactggaaagtccgatcgcattgacaaatacgctgtgtgtggggactgttcagcaggcattggtgcgctatatgctgcaggatcatccggaaatcggtacgacgagcggcactgtgaatgtagtggttggggaatgcaatgacggatatctgaatgatatacgggcatgcagcattcaggagtcaaatgtatatgaggcgattgcggatgcagggaaggattttgcacttggggctgtgggagcaggtcgcggtatgagttgcttcgaaatgaagggaggtatcggttccgcgtcaagagtgctggaattgaatggagaagaatatacggtggggcttctcgtcttatctaatttcggattaaagaatgattatatcaaggaaaacgtatcctttcatgattctgtgaaggaacaggtggagcagggcagtattataataatcctggcaacagatataccaatgtccgacagacagctgaagcgtgtatgcaaacgtatgccggtggcactcgcccgccttggttcacatctgggaaatggcagtggcgatattgcgattgccttttccacagcaaataaaattcctcattccgctgattgctcatttatatcgcaaactattcttcatgagcagcagattgacaaggttttccgtgctggcatcgaagcctgtgaggaagcgatacaaagctctctggacgctgcggaaacggtagtcggaagagagggccattgcaggtatagcttaaaggatactgtagcaaaaatgaagaaaggataagaccgttagtaaacagtatcaagaatgagaaagggtgatgcctgaaattgcttcaccctttttgactatgcatctgctattgacattttgatgtacttttgcagttctgaatcacagcaatagatatagcaccccttcatccctcttgtcatcaacgtgtaatacgtattcagtataatctgtcgttcaatatgttttgccttctccggattctcacgatacagctttttcagcccctttacagaagaatccgttttcgctctttgcctgtagtcagtcacaagctcattgttttcatagcgaagatcttcaccaataataactcctacataatcaaattcaagcccctgtgtagtatgaatgcaccctacttgatgaacagatccctgacttattgcatatggatcaccagcatccagattccagctcattttgaaatcaccaattacaatgtcatcgtgattcggatcacttctaccggctttttcccactcccagcagtatcccgccaatattctggctttccctgattcatcatttttttcataaataatatctcttaattcatttggatcatcaatgacacgaaaatcaaagctgatatccttgaaattgaaatttgctgtttcttccagctgcagcatatttcttatccaggcaagatatccatccgatccgttacagcgaaactgtgaatgtaattcatattgtataacctctgcattttgtagctgtgcctgtttctgaaactcggagatacttccaaaatcacgaaaatgaacacgctgatagggatcgataaagaaaacggtaaagagtgatgaacttatcagctcctgtatctggttttcacctttttgaaacatacctgatttttctcgtaatctatgcgcttcatccacaatcaaaaaatcataatcatttggttgctgctgataaaatttatccggtgcagcgaacagtgatttgattttgtttttcttcattttaccagcaagtctatctatatacacgttgcgtggagccgcattctttgttatatattgtccaaacatgtcttccttcagcagattcaccatcgcatttacagcaatcacggacttccctgttcctgagccgccttttgcaatcattacccgtttctttttatccttttgacacaatttagccatataaaggatttcttcatagaccactttctgtgtatctagcatcgtaaattcctgattaccatccagcatagaagaaatgcagtcctgaaggctcttggagggtcgaattctgccattctctattagaaacagcacctccttacgatccccttgttttaaatgctttttgataaattcccgcagtctaggaatttctccctgtgtgaataatggtgatttctcaatacatgtattgtaaattggatttatgatattttgctctttctttaaatcatagttatgcagatatgcacaagggtacagctgtatgtcttttttccctacttcttcgatataatcattcatatgctgtacataggaccaggcctgataacagggatgtacaacacgatgcactccttttcccagcgctgtcattacctcggtatttatcaaatcctcgcggttgaataccgtttccacacgctcccattgctttagctcgatgataatagcacttgccttcccatcatgattatatccggacataataaaatccacacgcttgtttgtttttggaatattatattcaatagctactccgcaggtatccggtatagtagggtcattcaataccttgtacatatattgaagtgaatttttccacgaggttacttcttttttactcgtatggatgtgcatacgctcataaagcttttcctctaaaagatgaggtattttatcaaggtccatatccattttgaaatcatattttgtcccttcgtatattaacatatttaatcacctccataagtacaggctattttaccattctcttacattataccttagttatcaatttattcaatgaaacattgatattgacacgccttcatgtaagcgctattatggaatagacaggggtgggagcatgaacatattggcacatataaatagcaatcaggaaatgcagtcattacaggagcacagcgaacatacctttacagcgattaaagaatatgcagctgcaagaggtctgacaaattgcatgaagctgactgcttttttgcatgattgcggcaaggcttccagggaatttcagaagtacataacaaaagcagcaatggaaaatatatttcttcccaaggttaatcattcatcagccggcgcgcagattctgcttgaggtgtgcagatcttacagtgatatgagtgagtgtctggtaaaactcatgttagcaaatgcaattgtttctcatcatgggttatgtgatttcataaatgtgcatggtgataatgccttgcgcagccggtgttatccgaaaaaagcattggatatggaacacattaccgcctttatgaatgactttatttccacagaggaattggaaaatcttttccgtgcagcgcataaggaactttcggtctatcttgcaaatttcatgaagcaaaaaacggctcaagatgcgaaggactattatttttatattggagctttacaacgacttctcatgtctttactaattcatggagatcgtgaagatactcgcaatttcatggaacacacacaaacaatcgtttatacagaagatactatatggcaagcagcaacagataagcttgagagtcatttagctgagataactgcaaattcctctttcaatccaatcaatgaattgcgtgccagtatctctgatcagtgtaaagcatttagcagccattctcctggtatttatcgtctgtcctgtccaactggctcaggtaaaacgctcgcatcacttcgttatgctctacatcatgcgaaaaaataccataagaagcatatcatttatgttgcaccctttaagaccatattggaacaaaatgcggaagtgatgaagcaatttttcaatgaagatcttgttttggagcatcattccaatattatcccatctcaatatacagattatgattactacagttcctcctggaataagcccgtaattttgacgacagcagttcgtctgttcgatgtgatgtttaaagatcgaacaacggatgtacgcaggtttcatcagttagccgactctgtactcattatagatgaagctcagaaaataccagttcaaacaatatcgatgtttaatgaaatgatgaactttcttgcttataattgtaatactacggtggtattatgtacggcaacacagccattattggaaactaccacctatcctatcaagttggcttcagaatctgaaattgtaaaacagacaaaggaaatgcaggaacaatttaagcgtgtccatatagaagatgcctgtcgcaggggcggctattcaattgctgatttatcagattttatatttcaaaagctgcagcccggctgcagcatgctggtgattgtcaatacaaaagcagaggcactaaatttatatcgagcttgtgagcagcatcatgaaatagacggacttcatctatatcatttatctactagcatgtgtccggagcatcgccatcttacattggaggatttaaaagagcatatggaacaaaaagatactgtgttgtgtatagcgactaatctgatcgaagcaggagtcgatatagattgtgatgttgtcatacgttccctatgcggacttgatagtattcttcaggctgctggcagatgcaatagaaatggtaaaaattcagagttagggactgtctatctcatcaattccaatgaagaacatatcgaaaaacttaaggatgtaagaaaaggacagaatgaaacagatattttattatcacaactacatgcttccaaagagggaaaccgtgtggatgagcttttaacactccccttcatacgtcagtattatgattcctatttgtttgatcgcagacaggatacggaatattcaacaaagattgagaatcgtaaagtttccttatttgatctattttcgcgaatagggagtaaaaaggaatctgatgatcttgctcatccttgtctggggcacgcattaaagagtgcgggagaaaaatttgaaatgattgattctcagagtattggtgttttggttccgtacaaagatggcgagaaattgattaatcagctgaatagttccattagcaatgcagaaaagtatggactgcttgataagacacagcgctttatggtgaatgtttatgaacacaagtataaggagctggagaaggaagatatgatttatcagcttgagtttaacggcatgctggttttgagggatgggttttataagaaggatacagggttggaggttaggaaggagttagaggatatgtttgtgtaaatagaaaaaggcatttagcctttcctaaaacataaatcataaatacacaaataaatttaaatccacagtttataactgacatacttattatatggtcaataatttaataagtcaaagaaaataaaaacataacaacatatcaaaaaattacgaatcatttcatattttcttacatatattttcatcttcttattagtataattatttgttataataatgccataggaagcatgtaagggctttctatatcctgtgttcaatcaagatttttattacaaattaggaggtgtgaatcgtaaatcatgaagaactcttgtaaaagaagagatgaagatgatggctatgtgctactacataaaggttttatgaatataacctttagaatcatttattgtttagttgttgctctcatctacgtactttttaaactgctttagattttaaatacaatatgatgttatttcatacatcatattgtatataaaataaatttattagaaagaaggtgaaaaaaatggaaaagaaaaacgaaatcacattttgcgtaaaaagtaaatatgctctttattctgatcctctcaatcgtgtatcaggagaaaagttttcttatcaaatcccaacatatgaagccttaaagggagtggttaaaagtatttactttaagccgacaatcagctggtttattgatgaagttcgcattatgaatgagattcaattcacaacacaaggtattcgaccaatcaattaccacggaggtaatactctctcctactacacctatttaacagatgttgaatatcaggtaaaagcacactttgaatggaatctacaccatgaagaattagaacaagatcgtaatgagaataaacattggttaatcgcaaagcgcatggtaaatcgtggtggacgaagggatatatttcttggtacgcgtgaatgtcaggcgtatgtagaaccatgtgaatttggtgaaggaaaaggtttttatgatgaccataccatagtgcctttcagtactatggttcatggatttatctacccagacgaatgggtttgtgaagaagaaaaaggcaagctgattgcgactttttggacaccagtcatgaaaaaaggtattattacattcatccgacctgaacaatgtgcaatcaggcgtattgtaggaaccggcgatatcaagagatttgaaaaagatatcaattttaagagtgttgaacatgaggaaggaggtgaattgcatgagttgggcgagtaaattactagaaacctatgatatatgtcagagtgaagtgggcaaggaaagtgaaacagggatgttattaccgcttagccacctaactacaaaagcacagattgaagttgttttggatgaaaacggaaaatttatccatgcaatagaaatccctaatgatgatgccgtcactgtcattcctgtgactgaggattcagcgagtagatcaagcggtattacgcctcatcctttacacgataagctaatttatatctcaaaagattatgcagaatatactggaaaacgaaacgatccgcatgttcttgcacaccaaagtcttctaaaacaatggatagattcttcttacacccactctagcattataccaatctatcaatatcttgaacaaggtacactcatctctgacttgatctcctgcgatatcttaaaattgaatggagaacaattggataagaaatataaaatccagaaaacagttgttcaaacagaagcttttgtccgctttaaaatcagaggtatacaaaaacgaattgttgaaccatggtgtgacaaaatgttattcgatgcctaccacaatttctataccagtcaacataccgacgaggatctctgctatataactggtaaaatgatgtattgcacagaaaaacatcctgctaaacttcgtcaaggaaaagataaagctaagttaatttctactaatgatgcaaacggttttacatatcgcggcaggttcgtttctaaaaaagaagcgatttccgttggatatgaaacatctcagaaaattcataatgctttgcgatggttgatacaaaaacaggcatataagcaaaatggacaaacgattttggtatggaatgcacactgtgataatattatgacggcattcgcattagacgaaagcttatttcctgctttaccggacaaagtagatacagaagaagattacgcacaacgtgtaaacaaagcaattgacggttataggcagaatatcagcgatcataatgataacatcgtcatcatggcaatggacgctgctacgattggtagattttcaataacctattatcaggagatagatgcttctacatactacaaacatctacagaactggttcacatattgtagctggcctcaatactcaaaagctgatcatatgagcgatgtaatgactccaattcccagagaaatcatttcttgtgcatatggtacactgcgtggtgcattctttgaagtggatgatcagttgatgacgctgcaaatgggacgcctactgccatgtatttctgaagggaaacctattccggatgattttatcattcgacttaacaatcagataaagaccatgtcaacgaatacgaagtataactggaataaatgtatcggtatactgtgtgcagtattcaaaaaatactgttacgatagagaaggagtgaattggagtgtgaatattatggaaaacaaaaaattagctaaatcaaatatcccctatttattaggaagaattcttgcaatatatgatgcaattgaacaatatgctttaaacattcaaaaggaagatcgtccaacaaatgcaatgcgtttatacgcaccatttcaagagcatccgtttgtaacgcttactacgctagataagaaaatcagaccttatgttgagaaactagggagaaaatgtgattatcttctttcaatgaaacaggacttaatggaagagttatatacagaaatggatatagaagctgtagaacacatccaaaacttaaatgcatattttgtcattggttttgattgtcagagaaatgaaatcaaacgaatcaatactgaaagaaaagaaaaaaataaacaaaaggaggagtctaaattatgacagcattcacaaacaaagtagatttcgcagttattttcacagttaacaaagctaacccgaatggtgatccactttctggcaatcaacctagaattgattttaagggatttggagaagtatctgacgtatgcattaaacggaaaattagaaaccgtctgcaggatatgggagaaaatatcttcgtccaatctgatgaaagaagcaatgatggattcaagagcttaagtgaacgtgcttccaataataaggaattaaaagcggttttaaaggatcgtgaagcttatgcttcagctgcctgtaaacaatggactgatgtcagagcatttgggcaggtcttcgcatttaaagcgaataatgtttctgtaggtgtaagaggtcctgtttctataagaactgcagaaagtatcaatccagttgtaacaaccgatatgcagataacaaagagtgtaaatagtgagccatccgaaaagcgttcctctgacactatgggaatgaagcaccgtgttgattttggtttatatgtatgtaaaggaagtatcaatcaccagctggcagaaaaaacaggcttcagtgaagaggatgctgagaaaatcaaagaagctttatgttccctgttcatgaacgatgcctccagtgcaagaccggaaggaagcatggaagtttgtaaggtatattggtggaagcataattgtttagcaggacaatacagttcagctaaagtacacaattctttaaaggttgaggtaaaaaatgatgtggatacgccaaattgctttgaagatttcacaatcacgttatctccattagaagatctagaaccagaaatttatgacggaatatagtgaagacgaatttttaatgctttcaggtatacaacattttgcgttttgccgccgtcaatgggcactcatacatattgaacaacagtgggcagagaattaccgtacgatagatggtcagatttttcatgagaatgcacataatggtgcattctctgaaacaagaaatggaatactcattcgtagaggactctctgtattttcaaggactatgggtattagtggtaattgtgatattgtagaatttcatccatcagaagaaggcatttctatttcaaaagattctaagcgctatctccctgttcctattgaatataaaagaggagagcctaaacaatatcaagctgatgacttacagttatgtgcacaggcaatgtgtttagaagaaatgcttttgtgtaagattgaaaagggctatctattttatggagaaacaagacgaagaactgaagtgttattttcttctgacatgcgcagtacagtcaaagcattttgtgaagaaatgcataaactgtatttaaagcaatatactcctaaagtaaaaatatctaaaaaatgcaatgcatgttctttaaaagatatctgtcttcctaaactgaatcaaaatccttctgttgataaatactttgataaatatttaggagataaaggtatatgaaaaaacttttgaacacattgtatataacaacacctaggacttatttatcattggatggtgaaaacattatcgccgcaaaagaagataaatctgtgtcgaggtttcccttacataacattgaagggattgttggatttggttttacaggcgtaagtcctgctcttatgggtaaatgtgcagatatgggaatatcgttaacatttatgacgatgcatggaagatttcttgctagagttgttggagaggaacgtggaaatgtcctgttgcggaaagaacaattcagaatatctgaatcaagcgataaacgtcttgcatatgcaaaaaacatgataacagcaaagctaatcaattccagaaatatattacttcgtgccaaacgagattatggtatgagaatagatgttgaaaaaatcgaaacagcagctgaagcaatcagattatctgcaaatgaagctagaaaagcggattctgcagactctttaagaggaatcgaaggcaatgcagcaaattgttacttccatgtatttgatgatttagttctccaacagaaaaatgatttctattttcatggtagaaataaacgacctccgctagataatgttaatgctcttctttcctttacctatacacttttagcaaaggatgtcacatcagcgcttgaatctgttggcttagatccttatgttggatttttacatactgatcttcctggacgcacctctttagcattagatttaatggaagaattacgctcaatcctggctgatcgttttgttttatcacttataaatatgaatatagtaactgctgatggatttacaaaaaccgatagtggtgctgtttatatggatgatacgactagaaaagcggttctgtcttcatggcaaaagaaaaaacaggaaacgataaagcatccattccttgatcaaaagatagagtggggtttggttccttacgttcaggcgctattacttgctagaacaattcgtggtgatttacctgaatatccaccgtttttatggaagtgatgagaaatgcttgttataataacttatgatgtcaacacccaaaacagcgcaggtaaaaaaagattaaggaacgttgctaaagtatgtgtgaattatggtcaaagggttcaaaattcagtttttgaatgtgttatggatcaagcgaaatgcagagaggttaaacacaagcttactggattaattgataaagaacatgatagtttaagattttactatttaggtaacaattacaaaaataaagtagaacatataggagttaagcctagcttcaatgttgaagaagatgtattgtttatatgaattattttgcgcgaaccgtaagctcacatgaaacccttgggaggttcgcgccttaaaattgcgttttatcgcattttgtaacagctttttcattttcataacattcaatagttatgaaaagaaatgattttgttacaaacgtcttaaaatgcaataattttcactgtctagcctccctgaggctagtggatttaaataactccataatatagcgcatatgggttgtatatagtctagcctccctgaggctagtggatttaaatttcaatgtcagcgattgctttttttacaatttttctgtctagcctccctgaggctagtggatttaaatatccctgtgttgtaccaatctcccgttaatgcaggtctagcctccctgaggctagtggatttaaatcgcttaccatgtcataattatcattgtcatatacgtctagcctccctgaggctagtggatttaaatctagttttgtttgtgatttaaacgttatatattcgtctagcctccctgaggctagtggatttaaatatatagatatgcgtaattgtatccatcatatttggtctagcctccctgaggctagtggatttaaattacttttagcaatcgtacagatacctgaataatctgagtctagcctccctgaggctagacattttaagcttagacaaaaaaagcaaagcactccttctaatgctatattttataaaatcctacttattcttcatatatggtatgactttagtaaatcattgaaacctccaaaaaacctttatttatcgtactttcgcaagttttaaaaagtatataccattgaatttatcgttttcacggaaaatttagtcttttatatgtgcctatctgtgaggtgtagtgtacctgtatgtaattgtatcggattacgagtaaaccaacgaggaaacgatagaaatgagacactgtacataaagttccatcaattactgttttgcaagtgaatcagcgttactgcaaatttattagccatttaaatctggatattttattctataacgcatacagtgatgaagtacatgaaggttacataaaaatatgtacagaaaaagaatatattgatgtgtgtcttcctttttaagtgcttaaaaacttaatgagtgcaaagcagcataaagctccaattgtacttaataatgttcctattaagtacttttcttgaaaatgatttttattattattgatatccttatatctaactaaagtttttgcagcaataataaaacctatggtagaaatagaatcaaagatacataataaaaaaattataattctctctaaatatgctatatacgtaccaatttttaactcatgattacttttctcttctttgaagataactttaaaggccaatgaaatcaatacgccagttggtttcactaatattaatatcgctaaaattgatattaaagccatattggataatatgattgttaaattcatatatgacgaacataaataaataatgaatatatgtataaactggtcactgcaaaatattaagcactctttttctttgtatttatttttcagtttaacagagcaaacatcgattaacagatgagataatgtgattattatcaataaggatacatttattttaaaatagataaaaagtaaaacaaaaggtattgaataaataattgaatgtatcagcataaaagtgtttaagttttctttattctttgctacttcatcactttgcaaataaaaatctccaacaacatggaaaataataaataataacatattatgcattatcaagttcctcaatcagccaacaagcaacagaaaaatcaatttttctattttcatttatatttcctaagcgaatatgtttatcaatattttgacgtgtagttcctaatatatctgaaatctttgtagacattcccttcttccatgtattttccactaacatattactatcctctaaaagtttgcgtaatggcataaaatatacttgaccaatatcatttgaaataactatgttgtttttcaattctcccttaggagaacttccgattcttgcataactcaaagactgcacaggtactatattagctttcatctctaatataaaatttaattggtctttaaattcaatgtacgaaaccataatgttttcatcaaaaattggatataataattcggcaattaatttaacattttgtacattcaccgattgttgtctttgaagcagctgtgacgagtataacattgcattcaaatatttatccttttttgttttcgtatttattctaattccaaaactatttttaccagaaaagctttctatagcatatctagcattatgatatacttcaccgtctaattcggatgatttccaattttcattatcaaatgctaattctccatatccaattcctgccctaatttttactggataacaaatcatcatgcaaaaccgaacacataaatacgctgccaatggttcataaaacaagccttgaatttcatcccctgcactaaacattaatggtttctttaaagatttataaaatattttattcaagtacacaataatacatttcataaattcttggatttcattacgatttttatatttcctagaatcaactatgtcaatcataatagaaccatactttttatttgacaatgtcttcacctcttaaatcaagtatatagtaaatagacaaacaacgcaacccaaataggttgcgttactttatttattaagacgcatatgtgggaacagcaacacttcccgtatcgtctgtgaatttgtcaacagcatcaccagtcggtcaattcccaatccaacaccaccggttggcggcagaccatactccaatgcctccacataatccgtatccatctcatttgcttcatcatcccccagatcacgcagcttcagctgattctcaaaacgctctctttgatcaatcggatcattcagctcagagaatgcattcgcatactcatgcccgtcaataaacagctcatagcgatccgcaaatctaggatcctgcgcattcttcttcgcaagcggactgatttccaccggatgcccatatacatatgttggctgaatcagcgtttcctcaacatacttctcaaaaaacagattgataatatgtccgacactgttatgcttcttctcaacctcaatatcatgctccttcgcaattgcacatgcatccgcaaagctcatttcctgccagaaatcaacaccgcatgcttccttgataccatccaccatatgtaatctcttaaacggtgccttcaaagaaatcgtcttatcctgccactcgatttctgtcgttccgcataccgtctctgccacatgattcaacagaccttccaccagatccatcatcccgctcagatcagaatatgccacataggcctccaccgttgtaaactccggattgtgtgtagcatccattccctcattacggaataatctgccaatctcatatacaccctcaaggccaccgacgatcagtctcttcaaaggcagctctgttgcgatacgcagataaaacggcatatccaaagtattgtgatgcgtcacaaacggtcttgcactcgctccacccagaatcggctgcagcaccggtgtctccacctcaaccaatccttcaccgtccagataattttgaatagcacggataattctaggtcttgtcaatgcgatacgcttgctgttttcattggtaatcaggtccacataacggcggcggaaacgctcctctacatcctgtaagccatgatacttctcaggcagtgggcgcagtgccttcgtcagatgcgtatacacctcggcctttacagaaagctctccatgatttgtcttcatgacctttccttcaattcctacaatatctccaagatccgacttcttgaacacctcataggcctcttcaccgataacatccttacgaacataaatctgaatctgtccgtcgatatcctgaatatgcatgaagccggcctttccctgacgtctcttcgtcatgatacgtcccgcaattttcactgtcagatctttttcttccagctcttccttcgtacagtcttcatatgctgcacgtatttctccggatttgtgtgttctctgatatgcatgcccgaacggctcgatgcccatggcacgcagatcttccattttctgtcgacggataacttcctgttcagttaacttttccataatctgctccttttctatttccatataaaaagctctcttccaacatagggacgagagcttcatcgtggtaccaccctaattcgccggcaggtttccccgcgcagccttagtgactgtgtttcaagtctcttcgtaacgtgaaggaaacgtcctgatcggaaagctccaagtctttatttcctgcaggttccactgctgcactctcaccaaacgtgcatactctctgaaagctttcacaaacagtactctcttatcacagccatatttacgattatgattatatagacaaaccctgcctttgtcaatcgaaaactccttaaaattaccgataaaacaaggctttccatgattccttccttatggtgaaaggtttacgaataccatgtggatgacaagcccttcaaatgcttcagcacttcatacaagcccttcagctatcgctgtcggcacgccatttcaagaatatgcagcttccccgttaccggcatcaaagtgctttgtcatccacctgatccagatagctgcgcactgccttcatgacatcctttaagcacccatccgcaaatggaaccttcagattcgctgccgcaacgatttgcgtgaatgtcttcgttccaccaatctgacagatgcgataataatcctcaaatgcgttttcatccttctgatacagacgataccagaactgcaatgcacacacctgtgccagtgtataatcaatataatagaacggtgtcataaagatatgactctgacggaaccaccatcctccattctccagaaattcacagtccgtataatccttatgcggcagatactgtttttccaatcttctccaggtctgccgtctttccgccggtgtcatttccggatgctcatacacctcatgctggaaatgatccaccagaacgccgtaagggatgaacttagcggctccgccaagatgaaggaatcgatacttgtccgcatcctcctcaaagaaggtctccatccacggccatgtaaagaattccatactcatagagtgaatttcacagctctcataggttggccagatacactccaccggtcggattcccatggaagtaaacacctggaaggcatgccctgcctcatgagtgagaacctccgcatcatggcttgtcttattaaaattactgaaaataaacggagagcgatcttcggcaaacacggtgcaatagcctccgcctgcctttccctttttactgtcaagatccagcaggtcatgctccaccatgaaatcaaagaacgttccacagcgttcatccagctcatgatacattgtgtttgcgcgtgcaatcatttcctgtgtatcgtatttcggtgtcgggttgccgcttgcaaattcgtatttttcatcgtatacgtgcagcctgtcatagcctaaacgttcccgctgccgttcatataatgcattgcataacggtacaacatcctccagaacctgccggcggtaatttgccacatcctcctgcttgtaatcaaagcggcactgcagcatatatgccagctcaacataattcttatagcccagctttttcgccatgcgatcgcgtaccttaaccatgcggtcatataaatcatcaatctcatcctggtgtgactgcatccatccccagtatgcctgggtggcacgtttacgaatgtcacgatcatcacattccatctttacaccaagctctgatagagtatagatatcaccatcgaagggaatctgtgcactggctatcagcttctgataactgctctgcaaacggttttcctcctgcagctcttcgattatttcatcacaaaagctcttctgtgcaaactccgcaagcaggaaataggtttccggaacatcctttttcaattcctccgcaaacggtgaagccagcacctctttgtcaaacgccgttgtcagggacttcatcttcggcattgcctcgtcccagtaatcgttttccttctgataaaaggcatcgtttgtattgatcgtatagcggacataacagatattatacatcgtatccagatgctcaaatgcccgtttcccctcatcaaatgctttcttgaagctttgatagtcctttgcttccttcagcctggtgcctgcctgctgcattgcctctgcataagcctcatagctgtaacgctcatagttataatccttaaatttcatgctatcacctcatcaatcattatacgagatatttcatgtaaaagatatccaaacaatgtgaaaatatgtctctttccttttgtttattgaatatgtacacacatatactgatcccttcgtgcaaatgaagagcgtattgaccatggaaaaccacggcggttttcaacagaaaaacaggaatacatgctgggacattattcccatatacctcctgatgataaaattgtcagcaactaaggtatatggataaaagatctgattcttccataccgcaatgtaaaaagaaaaaccgtctgaaacggatggcataacaaagcacagcgatatctacccggctatgaagcaccacctcaacggttcccctgtttatactgttcctgtattctcgcatactctgcttcatatgcggataatatgctttgcatttcctcgtaggtttcgattttgctcagctgatccttgagctgatggctctttggcagccccttcacataccatgcagcatgtccgcgcatttctcgaataccgacgaattcacccttcagattacacaggcgttttgcgtgcagtctggccattgcgaacgtttcctccagcgttacctccggcatatgcttaccgcattccagataatgggcaatatccttgatcagccagggatcccccaaaacaccgcggccgatcatgacagcatcacagccggtttccttcagcatcctctctgcatcctcaccgcttcgcacatccccgttccccattacgggaatggatacggcttccttcacctttttaatataggaccagtctgcacagccctcatacatctgttttctggttcgtccatgcacagcaagtgcctgcactccgacagactccagaccgcgggcaagctcaagacaagtaatctgatccatatcccagccaatccgcatttttacggtaaccggttttttcacactctgaacaaccgccctgctcatttccacagcatgatcaacatccttcatcagggcgcttcccgcaaaggatttcacaatttttgtgacaggacatcccatattgatatcaatgatatcacaatcggttttttcatccagaaattttgcggcatataccattgtctctatatcatgtccgaaaatctgcatggccaaaggatgctcctgttcctcgacatccgtcatacctactgttttttcattatcataatacagcgccttatccgaaaccatctctgtataaataagaccggcaccaaattccttgcagattacacgaaaggcaggattggatatccctgccatcggtgcgattaccacctgattcggtattacaatatctctgattttccagctgttatttggcatgtgcatccataaacctttccagctccagaagctcttcctcgctgaattgatatttctctccacagaaattgcaggtaatctcacagccgtgatcctcttcgatcatctgctggcgttcctcctttggaagggttgtcagaacacgcttcatggttgcacgatcacatttacagcggaattcaatatcctgtcctgtcaggattctgacatcgtcaaacagatcacggagaatatcctccagactttcatattcctgaatcatcgtggacatatgccttagatttgctacaatctgttccacctttacgatatcctcttcctctgcatccggaagcatctggataatcatgccgcctgcggaaagaatggaattatcggtatcaaccagtacaccgacactgactgcggacggtgtctgttcacttgcggtaaaatagtaggcaaagtcatcaccgatttcaccactctgcagagcaacggtaccgctccagttttccttcatgttcatatccttcacaacttccagatatccgtcttttcccacagcagctccgaccgccagttttccggtatcattgtattgcagcatgatatgcgggtcactcacaaagccgcgcacatgaccgtcactgtaggcatctaccagaatggtaccgatgggacctccgccgttgatgcgaatcgtaatctgttcctgtgctgttttcagcatgcttcccatcatggaacccacagttaacacacgtcccagggtagccgcactagtcggccataaatcaaaacgttttcttgcttcctccgccatatgcgtagaagagcatatatagattctcacatgctcattgcacgcaagcgcctttactaaataatctttcatcatagaaatcactccctgccttacaggcaactgtagtataccacaaaaacctgcagaatgagaagaaaatcgacttcgttatactgttgtgtacgttgaatgctgcaggcaaggaaaaagagggtgaatgtatctgatatatagaaaaaggtacagtattatctaatcctgtacccgtcgtatgcatacgttaatcgtacggcttgatttccactgtctttttatcaaagtctaggaagatctgaaacgcattgcggttctcatcctcatcccatatttccacgaatcgcggggttacctcaatcagaatctccgtatcctcatggctgtatgcattatagctctgccacagatatttcttatacaaggcttcaaaccttcttcccggctcgtccacgacaagccccttgtttacggcgattccctctacctgaacgccacctgtgcagagtgccacctgcgggtttcgatacagctgctgtgtcttgcggaaattcttatcggtcttgaaatagatttttccatcataaaacagacagcttacattacgcaccatgacgtaatcattaacgctggagccaagtgccataattttggaatctcccagtttgtgaaacagcaatgctactccttcttcaaatgtcatcttcttttcctccttactgacgatttgcgaatcggtgaatcatcggacttattttcttgtatacggcaaaggtaatcaggcagctgataccgtattttatcaggttaaacggtacgatgcccagtatcaccatggtagtgacagaattcatcatcggattgaccttggaacaggaaaggataatctggtccatattcatatcatacagggcaacatagaacggaataatcaaatacagattggtcagcactgcaacaaaggtactaaccagagtccctgctgtcattcccagcagtgcttcctttcgtgtcttcttgtgacggtacagcaaagacgcaggcagtaccagggcaactcccagcaaaaagctctgcagctctccggtaaacatggaattggatccggaaatcaccatctgaaccataacacggataaagacaatcagaacacctgccaccggtcccagagcgaaggctccgatcagctccggaattgcggccagatcaaagcttagaaagggcggcataaacggaatgggaaagcgaaacatcatcagtatcgctcccagtgcaccaagcataccgatcagggcaagccgttttgcactcatgttgtttttcaattcacatctcctccatttcaaaaaaacacctgactacgaaaaaactcgtcttcaggtgtgcgtttacagaaaatgtcttttctcatccggactttaccgtcggtgccagaatttcgctggctcagccgctcattacgcgggtcatggactatcaccatcggtagggaatttcaccctgccacaaagacttgttattcaattttgaatgcaggtcatgcgtcaacacaatctgtatattcattatagctcatgaaacagcatgtgtaaataagaaacagaaatgtaaattttttcatgtatctgatgtaatacgcatcgccaagtagaaaacagtacagaaaagaaacaccgggttctagcctgttgctgataaaatatgtgagcaacctgctgttttgtaaggtgcttttcctttcattcgtctttagtgtatgtagattccaataaatatcaataattcgtggattatttaggaattcagcatcttccatacgtatataggggtgtaaggaacccttacagaatggaggacatataaatgtcaaatgcaatgaatcagctaaactacagtaacgatcttttttttaagtacaccctttcccgtgaggatgaaggctctgtgtacgcccgcaacaccattattgaacgcgttaccggaatccgggtaaaggaaagcactgtgctcaatcccaatctggatccggacattatcggaaagaagcgcatcattctggatgttcatgtgaaggatgaacaaaaccgtcatttcaatatcgagatgcagaccacctacaagggattagcggaaatgatgcgttttgaattttacggtgccagagcattgaacaatcagctgaacagcggtaagaagtataaggatttaaagccggtatatcagattattttcattgacgagtatgcatggaacaacagaaatctgatcaatcagtatcagatgcgcaatgagcagggagagaaggaaagctactatccgctcatccttcgcacctatattcatatgccggcaatcaatgacatcgtaagggagaaggaaatacagaggctgaatgactttgaacagctggtgtatctgtttgaaaacaatggaaaaaatgatatactgaagtcaaaggaaaggctggtgaaggtattcatggacaagtacgaggaaatgcagaaggatgatgagctgtggtcaaccgcaatggcgattcagatgggggaggcacgttaccgctatggcttggaggacagctttgaagaaggaaaaaaggaaggagaagcattgctgttaataaagcagcttaaaagtaagtatcatgaggattgctcagcctggctgctctctttgaatgatgaacagtttgaagccgtatccaacttgatactggtctgcaacacttatcaggagctgaagaatcaggttatgtcaatgtagtaatacatacaatcccaaataagaaaactgttttataagcataagactttataaaacagttttttcatccaactttctgccgcatccgtatcacaggtattaaaaatattgttaaaattacatgatgggatgctgcatatttttaacaggtatcaggcgctctgcgttaatgcatggaatgctcatagataaggaaatcatacacctagaactcagcgcagaatttgataacatcctttagggatatgctttccttcagcaacccatacacttccttcagcttatccgcggagtgaaaattctcatacatcttcataagagtatccggattgctgttttccttcaccacagcataccgcatagccgcagctgccgcaagtaggatatacccgcatttctgtccatatttttcagcaagccgaagaggctcatacagccgctcttctttgttcagcttccgttgtgcctgccgcgcattccgatacaccgtatcatagatttcccgattacggaatttatgcactgctcgcatggtaaaggcaagctgcacatcctgttccactgcatattctcttgcgatgattgtactgacaaccggtactgctcgatccatcagctccataatctgcggatcatttgcggcttctccgtaaacctcatattgcagataatccccaagatacgcaacaatcgcactcatgaaattatacgtataaatttttctttgaatcagggatggaaaatctgcttccagcggcattcccacaatgtctggaatcatcccctttacactgccgtccactggcagctctgcgacatcctcgctgatcagtgccagacttttttcctttggctgcagtgttgtacagaagatcacaccctcggaaatgctgtcggatatattcgcatccacaagcggctgttttacgtggacaccgttttcacagcatacgatccgcaactgcttttcaccacacagttcagccgcagcactcagtagccctaccagcttctttatattgcctgcgaatacacttgtcgtaatcaaatctgagtgtgccagcttctctatgacttcctcatccgctgtcgtataagcatcatagccggtaacagtaaccggctccttcccatcaccgaagtagtgaacggtataggatttttccgcattcagccggtcgataagctctttatttttatcaataaacgtaatatgatatgcatttgtctgcaggatgggtgcgataaagccgcgccctgtctgtcctgcaccaataagtactgcctctttcatgttcctccaatctcccatttctccatgggtccatatcgcaaggcggttgacatctttttaacatgtagaacttgcttttctacattgctttttctacagcccatgctatagaaaagcaaaataccttatggaaagcggcctgcgctgcagaccgctgtactcttatacaagtggttacatttaacccttgtgctttctatcccttgctttttcctccggataccggaatggtgacaccggtaatatagctggcatgatcagaaatcagataacagatcagatccgctacctcatacagatggcccggtcttcccagcggtatagaggatttgtagtttttaaagaactcctccggtctggtgttgacatcccagccgcgaccgtatgcctgtgctctatatttttcatcattattggcaggagtacggtccagaatatccggtgccacaccgacaacacgaatattatacggtcccagctcctttgcccaggaaattgtaaaggcatgaatcgcagcctttgtggcagaatagcagctatgtcctctggagcccatcaatcctgcacaggaggataggttgatgataacaccctccttttttccatacaatacgcgtgttaccgcctgtgataccagaaaggttcccttctgattgacaccaaccataaaatcaaaatcctcttcgctcagctcatactgcggttcgctgccatagtaatccacaaggatcctcggtctggtcacaccggcatcgtttaccagagcatccaccgtgccgaatttctgtacaacggcatcaacagcagcctcaacctcttttttgtttcggatatccagatgcacatacatcctgcgatcatcctcagaaaaatccttcggctttgccagatcgaagattgcgactctggcattgcaggcaagcagatcctttaccatggcttctccgattcccatcgcaccaccggtaactatcacaaccttgttattcaagtcaatccattgcttttgttccatacatgctcctccttatacgataccgaagaaggaaagtaccacagacagcaccaggatggataccagaatgcgcacatacttcggaccgcttttcttaatatagaaataaatgccaaacacgacgaacagcggcagaatattcgggaaaatcttattcaaaacatcctgcagcagctgtttttcaccaactgcatttgcccatgatatcggtgtaacaagctttacataggtggaagacaatgcccccatcataaacagaccaagcacgctggctgtcttgataaactgattcagcttaccggatttcagaatggataccactgattttctacccagtgtatagccctttgtgacaagtgtatacgcaagaaatgttatggcaacaccccagatcagcagcggtccgacacctgccagccagttcccctctgcggccagtggaataaacatggatagcagcagcggacgaagcattccgtgattgatggtgtctccaattcctgccagcggtcccatcagaccaaccttcaggttgctgatcatatcagcggaggcctccagttcttcactgcccgccccttcctgcagcataatcgcacgctcctcctccaaagcacaggtcataccgaaaataacggagccccaggttgcctcagagttgtagaacattaaatgacgctgtaatgcttttttgtattcctcctcatcctccttatacagcttcgcaagaatagcactcataccataggagaatgccggagccgtcaaacgctcaaagccggaatttacctcggcggtaagataatattttgcccagcccttgattacctcatttttcttcagattaagttcgctcatatcagaaatctccttcatcatcatccacagcgactgtgctgcctgtactgttggtaaactgcgattgaagaattgcaatacagattgcaattaccgcaattccaatcgtattcattcctgtataggcatacatcgcaaagccaagaataaagtatgggataagctcctttttcccaatgaccatgatagttaccgcaaagccaagtgcaggaagcagaccgcctgccacactcagaccgttcatcgcccatgcaggaatcgcattcaggaacgcggatacggcatcggttccaaacagcagtgccagtgttgtcggaagaacacgcagcggaatggaacagaagaacggataccagaattccgctctgcccattgccttcatatcacctttttcagctgccttgtccgcaaggtggacaaagtaggaatgataggtacgcttcagattatccagcagaactcccagaagtcctaccggaacagcaatggttacagcgatatccggctctaatccggctgccagtgccaccggaatcgtaatgcaggatgccagcgcctcatccgcaggcagtgtacctcccggagctattgcgcctaaataaatcatctgcagagatgcgccgattttcatcgcatcccccaggtttcccataataagtccaatcggaaccgccagcaccagtggctgacggacgagatgcagtgtaccataccagagtttattggttgccagccagtagagtacaccaaataccagggctaatcctatgttcataaatatctccttttcatttcattttataattcctgaaatatgctttttaatgctccctctttgctgtaccatgcggtttaaaccctcgttttcaccgcatgtcagcattatttccctcgtacttccttcaaagcgtcgtggagtgtgaaggccggatccttcggcgttacctgcagcgttaccgctactccctcattctgcatagcctccagcatttccgcttcctgttcgcttaacgacaactcatttgaaatcatgaccttgtttgtcccgttgccaagaccacctacctgcagtgccttcatcggaaatcccagatcaaaggccttctttgcattttccacagatttaaacaaaatcagcagcttcttatccttgaatacatcctttttaaatgcagctaccgctttttcaatcggacgtattgccacctttactcccggaggcgccgccatcaggaatacctgtgccaaaaacttgtctgccgccagcttatcatccacaatcaggatggaatctgcggatacctgcttgatccagttcgtgacaacctgtccgtgcatcagtcgaaagtcgattcgtatcagtttgatttctgtcatgctcttcaccctctttcttcatcgaatgcaattggattcggctgtatgatggacgctctggccgcctcaagaccagcctccattaactcctggatcgtgcattcttcattgttgcgcttcaagatcagctctatcagcatcggcagattgataccgcacactacatggagtgaaaactcccgctgcagcatcatgcccacattggagggagttcctccatacagatccgccaacacaaggatttctccctgaacgcctgttagatagtctctgacctcctcgtaatactcctctattgacattccggacaatagagaaactgcatgaatatgctctgtctttcctgcaatcagctctgcgcttttgatcagctcctctccaaatctaccatgattcagtatcacatacgttatcggctctatcacttcttcacttcctttacctaatgttcaacggcctttgaactacacccttactttaccattgcacgagccttttattttttcttttattgcaccagcaatcgtgcagcttttccgaaggattgctttttccattctgcacggatgctcgtgcaataagattaaaatatttttgaaatggattggggtatactagaaaatgaaacagagggggtaaggattgcaggtgataaaatgctgacaaagagacaatactcgatattatctttttatgtggaaaaccggggaacgtatgtttcatccaatgaactcgctgctatgtttgatatcagtgtacggacagtaaaaaacgagctgaagatcgtccgtgatttttgcgattcctattcctcatttgtactggatacacttgcaggaaagggaaccagattatgtgtactggatgatgcggcatttgaaaaggacatggagattctgcgcaagaaaacgctgcagctttcctgtaatacaaaaaaccgagttcactccgttatgaaaatgctgatggatgcgaccggctatgtatcgaaatacacactgacagagaccttctatatcagtgaatccacactgtatcacgcactgaacgaaatcaaaaagctgttaaagcaatacgatcttgcactggtacataaaacaaatctcggctataagatcgagggcagagaaattgacaagcggatgtgcatcgcaaaaaatgaaatcaatgatgaatccaccgatcactttgcattatccgaggatgtatcgaatatatacaatgtagtggctgatgtgtttttcaaataccattatcagatcaatgaacagaccattcagaatattactgcgcatatcgcactcacactgcgcagagtcagaaagggacatttcattgaacagcaaatggaacaggatatgccggattccacagaatatcagatttccacggaaatactgacgcgctttcttaccagataccgcatcaagaagcaatacatgatgaacgagatcaatctgttgacgcagaccattctgggaaagcttgattactccagaaatgatcatctacaaaaggaggtcaatgattttatcaacgattcctttttgtatattcgcaacaagttctgtgtcaactttgagcctgcggaaagcctgaagctgtttcttgcactgcatctggtaccgctcatttaccgtatcaaatccggaacacagcttaataatatgatggcaccggaaatcaaacagtcctttccgcttgcttatgatatcgccctatactttacgctgctgatcaaggaacggtttcatctgaatgtttctgcggatgaaatttcctatctgtccctgtatttcaattacgggctggaaaatattcatctgggaaattccgcaaagaaaatcttgattatcacatcgcttcgcaagtcggaaacagtcctgctgcgtcataagattttaacctggtttcccaatcagattgcagagattacctttatcaccggagacaatgacgatttcgataccgaggattatgatgctattttctccaccgatagaaacagtgagaaatataagggtggtattacactgatcagtattttcccggatgagaaggattttgaaaaaatcaatctggcaatcaacggctatacagacacggattccatactggagaagttcagtgaggattgttatttctatggtgaggtgaaggataaggaagaaattctggatattatctgtcgcaatgccattgaaaaatataagctggatgatgagtttctggaggtcattaaagcaagggaacagattaccagctcttacttcggtaactgcattgccgtaccgcatccgctcacaccgttttcggatgaaacctttgtatctctgggggtattgaaaaagcccatcgcatgggataagaatcacaatgttcgtgtagttatgctggtatccattgaaaagaataatccgaaggcatttcagttctggtattatatgagcacctttgtgcgcaatgaggagctgctgcagaattttttcaaaaaacccagctttctgcgttttacggaaatattgaaaatatcactggaaaaggattttgactagcctgctggttggaattcttttttcatatagctgccttcgtttttacagcttctgtttcataaaaagacaagctttaagctatcgattcgatcctgcttacggggatacctgtttttatttttgtacagctttgccgttgcattagtaaaaatgacatctgcaatcctgtgcaaatgccattgttttggttatggtaattcaattttttgatatgcttccatcgtatgcatctccagctgctgttcctttcttttgagatcacgatagaaaaacaccatcagacacggtcccatgagcgaccatgcaatcggttccgcaaggcacacaccggtatagccggtaaacgggatcaaggcaaaggttgccgctattttcaccgccatttcgatacagctggaaatgatcggacccctgccgttgcccagaccctgcaaaccgtttcgataaataaacaagacagccaggatgaaatagaagacactgctgatgcgggtataataagccgccagagagatcacctccgtctgctttgcattgacaagaaagccgatgaagaagtcaatgcaggtaaaggataagagaaccacaatacacacccacagaaagctgatccatacactggatttcatacctgcacggattctggaaaaccgctgtgcaccgaggttctgagaaacaaaggtcgtatcggcaatcgcaatgctgatcagcggctgcataaacatttccactaccttgcgggctgcggtatgtgctgcaatcgttacttctcccagactgtttaccgcactttgcaatatgacagagcctagagaaacgatggaattcatcaagcccatggaaattcccatggataactgctttctcagaatttcacgctcgacatggaaatcctcttttttaacgatgaacatcggatatttcttacgcatataaagaaagcagaggataacgcttaccagctgtgcaataacagtagcatatgctgcaccagccacccccagctggatgattgcgataaatatatagtcaagagccacgttgagaatggatgctatgattagaaaatacagaggtgtccgactgtctccgatggaacgcatcatactcgccatcatattgtatgccatggtcacaaacagtccaacgataataatggtcagataggaatccgccatccccagaatggaggatggtgtctgtaacagatacagcagcggctttttcaacaggattgcgactacaaagatcacaacaacactgatcatgcaaagcttgatacatcctgccgtggcttttttcatgccctcttcatcacgcgctccgtaatattgagcaatcatgatggaaacacccatggaaacaccagtgcaaagtccaataaccagattggaaagcgacgcactcgcaccgatagccgcaagggaatttacccccagaatctgaccaaccatcatggtatccgccatggtatagaattgctgaaatacattaccaagtaaaacaggtattgcaaatgccataatcagcttcgtgacattgccctgtgtcatatttttcattttatcacctacaaggtttaattttatcatatttttcacaataggaatacaggaatagaaaaaaatacggatgacagcctgattcttttgttaccgttcacagtcctttggaaattaagaaatatcagcatattgagatgatgatatatgtctgtatcatttgcactattatactgattgatcatagttaaatctaatatgcatgatgtatctgtgaattataacagtcttttaaataactgaaaagataattttaaaaagatgccagaatctaaataaatctggtttcttttttacaagacagcgtttttgaaatatgatattccataacatattatctaatcatattcatattacatatgctgagaataataatcacatcattaatcattacttaaaaatttgtgttgaatataataacaaaacagattagttttcaaaccaatctgttttctcttttaactatttttctgtttttctttcttcatccatcgtaattcatacatgcataataatacaaatcctactgcaataacaccaataccgatatacggttgcttcataattgttaaaacaaccatcacatcaatacagtcatgtccaacacctgttgcaccgtatgcagcgaaatcgaacaaagtgaacagaaatgctgaagcaaatattaagaggaaaccataaactaaaccagatattgctgctcctctgcggcctccggtagcattacccagaattcctgcaacgccacctgtgaagaatgcccctattatagatactagtggtacaactccaaatactgcagatgacacaaccattgcaataatcattcctataactgaagttatgaatccaatcatcaatgaattaggtgcataaccaaacaaggctggaacatccaaagccggaattgctccaggcaccagtttatcagaaatacctttaaatgcaggaacaagttctcccaaaaacattcgtacaccctgtaataaaattagaataccagcagtaaagcccattgcttttaaaactccatatacaatataattggtagattctgaaaactctgatactttttcaggccctgccatgatgaccacaataagataaaagacacccatcactatggaaacagatatagacgtatctttgaaaaactccaaagattctggtagcttaatatcctcagcactttttgatttgtctcctaaaagaccgccaacatatgcagatggtactgtacctaaagttgttagatgagcaataccaatataattattacccgttaccttgcgaactaatggctgagccactgctggtagaataaccataagcattccctgtaataaacttccgattccgataatcataggctcagagaactcactgacatataatgaaaatgcaattacaacagacaatatccacatcatatgaccagtcaaaaagatatatttaagcggagaaaatctggcaagtgccacattaacaagaaatccaatagccataatgagtgagcttgtagatgcaataaccggaactgcgctctgcattgctccaactactgcttctgatcctgttgcaaatccggacagatgaaacacatcagtaaataatgaaacaaaaggtaaaatctctgtaacaataagacttgaaccagccgacagcactaacatacccaatgctgttttcaatgttccactaaagatttgagaaaatgcctttctttgcagtgttaacccaattagagcaaccagtcctagaacgattgcaggtgtttgaatgatatccagtaaaaattttaacatatgatattcctcctacagtaagcttttagcttcaagataagtcttcaaagctttcttcatctcatttacatcgacaatattctcgacaaatacaacattatcttgatcagcaaattgctttttaaaaccgtttgttgtaacaattaaatcacattccttccccttcaccgtccccatatcccaatgctctatgttacattttactcccaattgcgccatagcattatcaaccgtaatcttcataatcaaagaagatcctacaccaagaccgcagaccgtaactatttttaacatactaatttctctcctttaactttctataaacagctgattaattcattataatcagcaatatgtttagcattaattgcatctcctttatcaagatttgaactaacataaataggtggaactacgccctgttcaacacataattcaactgttctcgctataatgctctccattactgtcattcctaacacagtagatgttccacaaaattttggttcaacaccttctattgataaacacgcatcaccagatatacattttatgtcaatcacgacatctgcaacatccttcagcaatttacctgaagaatgtcgagaagttacactttcagtaaaatcaagggatgtaagagcaacaacctgcattcctattttcttagcctctttagccatatctattacaccggcatttctcccggaaacagatatgataatcatagtatcatcaccggatacattttccagattgagatactgatctgaaaaaccttcaattctttcctgaagcgtacttagtttagccttaggaaataaagccagatgtggaataagaagtgcattcacaggaacaagtcctccagctctataaaagacttccatagcaaacatttgagaatgtccacatccaaacacatgaataacacgcttttttattacggaagcagcacaatatgtcgctgcctgctcaatatggctctcttcctcttcaaactgcctttttaactgttcttgtacaatactaaaatactctttctgtttcattttctttcctcctcagtattgactgaatttcttcatcagttcctttttagtaccatgatttcgtgccaattccagaaactcctcatcctgaagtaatgccgccattttaaccatcatttgcatatgagagccagcatcaacagcaccaaatccaaatgcacattttatatgctgattatcaaaatcagtgaatactacatcttccttaaaggttacaaagctaagacatacttcatgaacactgctatgaggtggaccatggaaaaaggcaatgtctggtagcaaaatcatataaggcccaagcttttcgacagtggtcagcatagaagtaatgaaaaaatcatcaattttgccctgctgttttaagagattacccacaatatataccgcatctcgccagctattcgcttccacttctgtctgaactagttccgcattcaataaattacaaatcataaaatccctccttcatttggttatgtcatcataaccagtcaattttaaaaaaatatatcaacagcaagcaattcatcatgatgttataaccagttgtgataaaaaaagaaatagttttgttttacgatgaaagcttcactgtaaattcaaagatatctcctttcgatacaattgtcgaataacagacaatcctatcgttactataagacgtcctcttaaccagcagaccgtactgatttttggcgcagtttagaagtttgcactctaaaggattcagctcacatgccttaaatgtttcaactgctttattaatcacaataccataatcattttcaagcgatttatatagtgattctttttccaaatcaatattcaaaataaaatcatatgtttcaaatacaaaataagttctttcaatcatgataggaatacagccatcagcacagcgtaaacgctcgatatatataatacgttcaccttcattgattccaagacgatctgcaagctttcgatcagctttcaacagttctctacttaaaagctttgtcgatgatatctttccttgcttctccatttctctggaaaagctgtatacattcccaagattttgaataatgcttttactcagtacgaaggttccttttccttgcactttttccaactttccctgtctggccaattcatctattgcattacgtacagttattctactcatgccgtacatcatgctgagttccctttctgaaggaattctagagccctgtttccatattccttcatttattttttcttcaattgattcagccagtttgcaataaagaggaactttattgtacgcctcattcatttcatcacatccattccaatgataccggttacacatctatattaaactggttataaccagttgtcaagaaaaatttgtaatttttaaaatttggctgaagtgaaaagttaaattccactttcaaagtagctaagtagaaaagactcttgcataacaatctagttgaatttacacttacaattgcatttagtctttcatatatccatttttatatctatgatgaagataaccgctggttattatcatacagattacaaagggtgatgaatatggcaacgaacaaaaacaaacatctgactcaggacggtcgcaatgtcatcgcgatcggcatcgttaatggttcttctaaaaaagctattgctgataatctaggcaaaggtaaatctacgataggtaaggaaatccgtgctcaccgttatctctctcataaatctacactttctctagaatgtgagaactatgcacactgtaagtttaagagaaagaattgtactgtcaactgccctgattattctaagttccgctgcaaacgcagagatcgtactccggaagcttgtaatggctgtgagaaactgaaaagctgccgctttgataaatacctctataaacctacgatcgcctatgaggaataccgtagcgaactcgttgagtctcgaaccggaatcaatctgacctcatcagaagctgtagagctaggcaataccatcaagcctcttctattaaaaggtcattcaccttatcagatcatagctgcacatcccgaacttggaatcagtgagaagacactctacaactatattgaacaaggtgtattcgaatgtgttggcctgctaatattgaccttcgtataaaagtcaaaagaaaaatgaccgctaagaagacgacgatctataaaaaacgacaagaccgtaaattccttgttggacggctttacacagattaccaatcctatgttgagtctgaggaaatcacacacatcttacaaatggatacagtctacaatgacatttccaatgggccatttatccagactttcaaattcatcaaatatgggctcctgtttgctgtatatcacgacacgaagactgctgcagatatggttgacggactagccgttcttgattccatccttggaaaaagcctgtttgaacaggaagctcatataacactcaccgatcgcggaggtgaatttactgatgctgagcatatggaaaaaagagacgatggtacccaatgtcattaagttaagaggatgaaaacaaacaggatgcggttttattttatctcattctgataggattaagagtattctgaaaaaaatgcatgacaaaaagaagatttttcaagcaatttataaacttttgagttataattatatcgtattaagaaaagcggtagcacaaacatactagcgtttgtgatttcacaagcctcttacattttcgattttggcggattggtaagatatcttgtgaaatgagagtttcaagatcaggcgggtgaccgccttttcttttataatgctggataaaatagcgacaatgaactatcgccatttttttgtttatcgcataagaatactgttttttcttaccctttcccttggctttttatttattatatgatgagccataataaaagatatattataccgtatcatccttgcccaaatctcctgttggatgctttctcgttttttcgcatgaacagcacacagatccgctgaatatttaaggtcacggaacgataattctataccccatcgagtattgtatatttcttttatttcatccttactaaattcatcccggcttaaatttgtgatgatggattcatattcttcactaccatccagcttaaatcgaactacaccgaaatgaagtacatactcaggattacgttcatcaataaaatcaaacgtagatgtagtagataagaaacgatatttctctggttgagattttatatctttggtctgttttcttgtcaatgtgatatgtaaatccaaatcaaattcttcatctggcagattgaattttcttaaaagactggaaatcgagtgtatatctttcacacgtatcaaaaaggacttacccgactgtatgatatgtgccatagtattccgggttgcataatttctatctgcgataaaaatagcattatcatcgtgaaaacgttcaactattttccacatggcttcgacctcgttcttactatgaatcccttgaacgatcgtatctaaataacccatcgaccgcaataagatgatagcccttatataaattatcaggtggaaatgctttattcagttcattcaaaatatattgaaaaacacgtgaagaaattttagaacgtgcctggacaagtgcagaggcagttggggtattatttgagtaatggaaaaaatcaagtagttcttcccggataggcttacccgccattgataagatgaatgaaacagtatctttaaaagatagctttctagatttacgagtgaaatcagaactttcatgtgtgacaaaatgttgatcatatttcaaacgatccgccttatttaaaatcttatccaaagaattgaaaagtgttttatggatagagatcataccacaatcccctcaattcttttatcagatatgaaggtagaacaagcattgaaattattactaaggatcatataagatcacctcctacaccttacaaaagcgcgaagtgtaacgaagctcacgatttttctgattttgtcaagcctaaataaaaaagacacctatactttttgtataaatgtctctcatctattcttctttaacttaatgacattgcgatggtaccagaaggacacgagtcttctattgcgaccctatgcagtccgggcagaaaggaagcctggaaaatatgcatcgtgaattacgttatatattacctaacgaagtagacttacgcagtatcggcctgaccgatcagacttccttgaatgtagccatctcacatatcaattccagtgccaaggaacatttgaatggaaaatccccatttgagctatgtgagttcatgtgtccggaattagcgcagaaactttatgaatttggtctacagaaaatagataaggacgaagtgatacttcgtccaagcgtattgactcataagtaacaaacagatgatataaagaatgataagagcagcggcaaagaacagttatttatagtgtaactataaaatggaagtggaatttagttatacataggcataatggagcctattttcagtgcgcttattcattttatctatcattcgcacaatgaccactttcttcacatttttacttacttctacctatttgaaaccctttctaacgctatatttatgctctgtatagacttttgtagaagaaagttccacattttttattcgccttttgaaagtggaatttaacttttcacttcagctttttaaaatttgcaaatatgttatttaaaagaggtgacacgtattcagtacagtaataatacgtgtaaggtttattattcactttctatattcatttttcaattcaagctatatcacattaattaattaattttaacaccttactaaggtgtaattgtagctgtatgaaaaaacgatggcttctctttcttttgaatctgaaataaaaaaagatttccatatatcttgtgatttttacacaatagattagaaatctcattctccaccgtatgagtagcactgcttccttgtttcagcacaatggtatcacctgtacaaagaattcaatgattttcggcagtgattctctggacaggtattcctgaaactgcaggtattcctgcgaatccagaaagcaggtattggaggagcgcagatggtatacgatatccccaaccggatttgtccccatcgcaatttcaccatatgcaagagcgccgatggcaaatttaaacccgatggaaatcgcaccgatactgtatacaccgatagcaatcgcaccgatgctgatgtagccgatagccagacagccaatggcaaagtaggataatgcaagcggaccgatggcgaacaatagccccagtgtgagcagacccagactgcatagtcccacgcttaaaagtccgatggaaatcacaccgacggaaacatttccaatcgcaataattcccttggcaaccctccaatagccttcctccgtacgtcctcttccaacattgatatccacaaggggaattccacagattgacagcttggagcgataccgcttttcatatgtatagcggttatgcacataaataacttccttctccttaacaacctctttttccagggggattttatttcccagcagctcatcaatgctgacctgcaagcttctggagagtattttcagattctccatatctggattggcagtaccattttcccacttggatatcgcctgccgcgatacatcacacagtgctgcaagctcttcctgcgacattcctttttcttttcttattcgatataaattgtctttgaattccatacattttcctcatttcctgatgactgtattctatcagtttctatgctgttttaccatacttcatacattccaaatccgcaaccactggtagcaaaaccgccttttgcagtttttttgattataatcacctaaaaactcaaagctttatacaaaaagcagaccttccatttcatctccatccggcctgcttttctgcattatcttttctatcctatatctgattttatcatatctgctacaaggcaccttgcttactgtttgaattattcgatatgatatccaatcctctttctacagttatcaatgcctgtgaagaatgccgtcgtcttctatttgtcagccttaaagcgttcaaatgactcaggtattccatatagtcttttttctaccacttggccagcttcaacaatcccatgcataccgcaagtgtggaggcgatatattgatgccggttccgtactgctctcattttctcatttctacccataaatacctatgtgtgtcaatttccatctatcatgtatataaggtgcaaatttttgcattaccggtacagcggcaggctcccgcataatctgttgattttctttttatcaccatacaggccaataccgaggtaatgaaactgattctccggcagattttttgccttcacaatccaatcctcatacacattgcaggtctgtgctgcatcactgaaatcaacgataatgacatcttcatattcctgatcaaacagctgccgacgcaactcctgaagcttttctgtttccatcttcagaatcggaagcggtatttgcagaatgcccatatgtatatttccatccgcatcctgaacatcacagccgatggcttccttccccttactacccagcgtcatccccagcagtgccgcggtatttgcggcaattcccggtgccagtgatgcatccatcaccatgacgcattttctgtttttctccatacacgttctcctttacgattctgcgacagcagaagacccaatacaatcatcacgataccaagcacaccgacgatagtgaccgtttccttcaaaatccataccgatgccagcgtagtgacaaccggcacagcatagatatacacacttgtctgtacagtacccagaatacgtacggcactgttccaggaaacaaagcacatcgcactggctcccagtcccagaaacagtatattggcaatatttaatcccgtaagctgttccaccttcggcagttccataccggatagcataataaccggaagcatgcacagcaaaccgtaaaagaagattctgcgggtcatcgggatggttgtgtattcaaagttgcttattttctttgttatcgtagaatatagtgcccatacgatggcagctcccagcgcaagcagatcaccctttggatttaatgccaaattctgacttccctccagggaaatacagagaattccagtcatggcaatcaaaaaaccaatgaaaaagcgtactccgggacgcgtttgttttaacagccagattccgaaaaacatagtgaaaaacggtgaaacagccacgatgataccaacattgcttgcctgtgtgtaggtaagtgctatattctccataagaaaatacagggtaactccacagagtcctgccgcaagaaaatacagctcttcctttttctctttaactctggtcagccttggagcgacagcccataaagccagataaccgatcataaaccgagtgaacagtatctgcaaaggtgtaaaatcccgcagcagcaccttggttgaaataaaggtggttccccatataagaatagtcatacacgcaagcatatgacccttgatccgctcattcatccaattcgctccttttctgtgtgaatatactctgatactgctttggtgttataccgataaagcttttaaagtagtttgtaaaatggctctgatcggaaaacccgcaatccagcgcaagcttaccgattgcttcaccctgttccagcagacgctttgcttttgcgatccgaatggattgcagataacgatatggagaaacaccaacctctctggtgaacagacgcagcagctgatagcggctcatcttgctaatctttgaaagtgtatcaagagaaatggattcttcataatgcgtatccagatattccttcatagccttcaccgcttccgtaagctctctgcttgcctctactggaaccatatgttcttccagcagctgttcaatcagaaagtaaaaggcctcctcacgtaccagcagactgctctgtgatacgataacatcatacagctcacgaatggacagtgccagctctgcctgtggaatcagcgtatccttaaactgaagatggatgtgtttcccggttatctcctttactgccttatccatgacatctacaggaacattgattgcacgataatccagaacctctccggctaccggcgcacaattatgtgtttcacgcggattgaataaaataacatctccgcgctgtgtatcatattcctgatttcgacaccagagatgacgttttccaccctccataaatccgattacataaaattcatgaaagtgaacaggaaatttctgtacgattccacttaaattatacgcctcgatctgaaggtctttatcataatagatgtgtcgctgctcctgcaatgctgccatgcccattccttctttctgtcgctgtatgtatggtaacataaaaaaaatgatattctcttgtaagatattgcatccggataagcgctgtaaaagctgttcgtgtgctgaaaaggcagaagtaggatgaaacctgtgtcctgcatcttgcatgatgacttgaaagtttgtgtgccaattgccgcagtaccttacgaaaaggttttgcatttatacagacgcacttcgcatggtcaaagacatttcactgtccttaaatgctcattgtgatttatcaaaagctgaaaccttactattctctttttgcgcatctatagtatagcatggctgcggacgcagaaacagcgcaatttgcacgcagccattctgcacactgtgaagctgaaatataaaagcatcattatgaaaattccagcgtgctcaaaaaaacttttgtgaataaaaaggaggaaattctgacaatctccttcctgttccttattctgccaatcccctacgctgccggtaatgcgcaagcgcccccagcagattggcatcctgccgatacgtacagcattccaaacgcggtgtcagtgttgcaaaatccagccccttctgcagcttctcatacgcttccatgattcgctgtgtaaaatcccttcgtgcactgattgcacccccaaacagaatcatttccggatccagcatatgctgcacattgaagacaccaaaggcaagctcctcataaaaggtctgaataaccttgctgcacagttcatatccctgctgtgcttcttcaaaaatccgcacaccattccattcttccgctgtcaaagcctccattttgcgcaccatactcgaggtagaggcacacagactgaaattttggacactgccgtccggctgctttaccagcatcatgccaaattcaccgccatagcgatgcgctccatggcaaatgttacgatttcttacgattgcaccacccacaccggttccaatcaccagaaacgccatatcctgtatgttcttcgccttgccgtaaaacaattccgataatgcagcacagttcgcatcattctctatttcacagcacagtcccagctccctctgtatcctttccttccacgaaaagccgtggataaagggaattgcactgcttccgccgatcacgccgctgtcacaattcactgccccgcaggagctgattgccacaccggacaagtcgacaccctgcatggtgatatccttcttatatgctttcatatatgcgagcagtccctctatgtctgcgctcataggataggatctggtatggaaaagccttccttcctcatctgcagctgcacatttcagagagcttcctccgatgtcaaaacaaagatacgtatccattagaacccccgtttctctgccagctcgcggaaccagcagccacttttctttatcgtacgctttccggtttccaaatcaatagaaatcagtccgtagcggtttttatatgcattcagccagctccagcagtcaatgcccgtccatacatggtagccgatacagttactgccttcctcaattcccttatgcagccaggtaaggtgctccttatagaaatcaattcggtagtcatcctcaattctgccatccttgataaaccgtgcttcgttttcaacgcccattccgttttccgttatcatccattcgatattatcgtatttggtacgaatgttggttgcaatatcatacatccccttcggatagatttcccatccgcgatagggattgattcttcggtttggcatttcatagaaatcatagaagctctccggcgttatcatcgctgcagggtccaccggtgtttccttcgctttgacacggatcggctgataataattcactccgagaaaatccacggtattttcctttatgactgcaagctcttgttcctcatagtccggcaaaagcgtatgctccttcaacagctccaccagctccttcggatatactccaagaacagcggggtcaagaaagcttcgagcagaaaacagctctgcaatgcgggatgcctcgacatcctcctttgcctgactgcgtggataattcggggtcaggtttaagataatgccgattttcccatcacacatcgcatggaaggcctgcactgctctggcactggcaagtgccgtatgataagccacctgtacagcagccttcatatcatggcggcatggataatgaaagccgttcagatacccgcactccacatgaacgatcggttcattgaaggtgaaccagcgccgtacctttttcccatagagagaaaagcaggtacgtgcatattccacataggcatccacaacatgatcgctttcccagcccccctgcttttgcaattccgccggcatatcaaaatgaaacagattgatcatgacctcaatgccttcctcatgaaaggcatcaatgacattatgataatgtgctgcggcaagcggattcagctcaccatcccctcttggaaacatacggctccagctaatggaaatccggcaggaattgtgtcctgtttccttcaagagtcgaatatcttcccgatactgtgtatagaatccggaagcctccttcggcccgattctgtcatgaaatttctcgggctcctgttcaaaccagatatcccatatattttttcctttgccatcaatggctgatgccccctcgctctgtgttgcgctggtggcacttccaaaatagaatcctttcggaaattgtagcataagcttcctccttataaagttatttctataaagcactacggcatgcgcttcctatatcgtaaaattcgttcgcttcataatgcggcaatactatgcttccataccgagaattatctgcatggcatgcgatattcctatgtgaaaaatgccgactgcatcgaaggccctctccatgggagagagcctttctatgtgaagctgtaacaactgcatatctgcagcttttctatgtctattcctttcgatcctttaaaatctcctctgtacttgcccagtttgtcaaagcgtcgctgtaggtgcgtacataatggtagtacagcatatcgatcatgattaaaatcggtatctgaccggatatcatcccggtggactcctccccggacagcgatgaggtatacagaacaacatcactgagctttttcaggcggctgttctgatttcccagaatgcttaccacaagaattccccgtaatgtcagctctgcggcaagctcctccagataggtattcccgcgcagggtgaagataaaaaccagatcctgcttctgcaatacccgcgagctcattttgatggcatccttatcatgaatgacctctataaatttaccgaggcgggaaaaacggaaacgaaagtcctctgctgcagtagcactcagtccgaatgcaaagatgttgataatgcgatgctcataaatatatctgcatacctgctccatcgccttggcatcaaagttttgatccaccagatgaaagatgcggaaatattcactctgtaaatccaatgaaatattagaaatctgcggcgcattctgcatattcagatgctgctcatacagatacatcagctccttgaaattgttcagtccgattttcttacagaagcgtgtaatggaggagctggaaatagaaagctctcttgcgagctcgtgaatcgtgagcggttttctcccgtctgtgaaatattgtgcaatcgtttcttccacataggtgaaattaacctttgccagattgattcttaaaagaatttccttttccatatgcattcctccatcgctaccggtattatactctatttcacgatgattttataggttctgatttcctccggctgtatgtttgacagcgtcacagggtgttgttcagcttcacagtcagcgatcggctcatgcagcatattcgtctgctgtatggtttctcctgtataacacagtgaatcttcctttaccatctcattgcgactgttatatacccgcagaatcgcctgtttatcatccagcggatacagggaagaaaattgcaggcagtcacttttatccatattgagaatagcgctatgcagaggttttaccgcattcggatacgggtgagttacaaagtatttctgtgtattcacaaagcggttgacctcctgcagctgataaaacaggacatcattcgcatagcgcagccatgttttctgcacttccatagcatcgtatccattccgcaggcacagggcaaaggagaagctcatggtctgccgcagctctgatttcggtgtcggtatatatttaaattcatttccgctcgcaattccaggacggcggttcaaatccggacgtccaagcaatggtacgctgcgaaacagtgtcagtgcgatatcggtatgcttcaggatttcatattcctttattcccttacagaaacaagtcagcacctggtttgttccattcgatacatggtgcagcatcggataaatcggcgtaggctcctcacgatagccagcctccttccagtcctccatgtgcttgggatcatgtgctctttgaatggtaccgaacggggtgtctgcaatactgcaggatgagctgcttaaaccacgtaaaatcacacgcatgcgatgctccatcgccgtgttgtcaatggtcatttcacattgtaatacatctgaggcctgatgcagctgtatacaaagcgtatatgcgatatcctgactgcatttcccatcaacacgctcctgcaaattctcgggaagctgccatgctccatgcaataccagcgtatccgcaagtgctccatgcttccattctgcctgtgcatcctgaaagtgaagcgtatagatatggtcatgcgccggccaggagtaatcataggtatctccctcatctccgctgtcctctacatacaggaaatcctcaacaactttcccgtttgctttgtccagcagtcgcagactgccgttttccatggtaatcttataaaatgtattttcaagagcactgcattcctgcagctgttccgtgtgctcacatgcttccagatgcagtatacgcatactcattggcttcatcgtcatggcaatacggatatcactctgataataatacaaatcctcatcgtatacagacggatccctgcgtatgcttccgctgtatacacgctgtgtcccaagacagtcataaacaacctcacagccggcttcatccacaatacggaagtgccttgctttcgtggatacagacacttggtatacatcatctctagtatatggcagcgtattatagaacaccagatcctgttcacggattccctcgatggattcactcagcttgcgtacctgataatccaaaagcatcgagctcatctgatcacagtcccttaatctttgcaggatggcatcgttggtagcatcactgttacagccgcaggcactgtcatgcgcatggtttaaaagcaccttcttccacagcttcctcaggagtgaggttttgggtttgatcctcatctgcatctgcataaccataaatggctccagctgataaatcatgcgtcgttcaattatatcattcagctgtttatgatcatagcgtgaggaataaatggagtggtgaatcttggaaacggaggcatcaataaactcgcccgtaatctgcggcagtccttcctcctctcgcagctctttaaagaagctttccaaatcgctttcaaaatattgaatatcatgtgtggagcgttcgttgtaatagttcagacgctcctgcagattgaaatccacataacgctgatcccctcccagaggaagcagctgatgggttgtggaggcaccgttcaaaacacggttttccaccttatccacatcatcggtgtaaatcagatttccaccatagaagtatccgtcccggatatgatagcacagcacttcacttccatcagtattgtgccagtaaaattctctttgtttacatacatcattgggaactcctctccagaacagagcttcgcgaatatcaaagccgttatacagcttgggcatatccttgctttgtccaaaggaatccggcagataaccgatcatcatacagttacccagttctcttgcatagcttatcccataccacagatttctcgcaaggctttctccactgatgatcagttcatcgctctgggtataccagggtccgatcatcagctttccttcttctaccagcttgcgtatcacaggctctttttcaggcatcatatgcagatattcctccagaatactcacctgagaatccagtaaataggtcttcagtgttccgctttccagtgcggaaatcacctcatccatgtgataaatcagctgtatgatggattcacttgcggtaaaataccattcataatcccaatgtgtatgagaatacacatgcattttcttcatagctatctatcgcttacagctccactgcagcgatcacctcatacagcgcatcaacatcagttccggttttcagtgccgttcggaattcctcactgatcattttgcgtgccagcttgctcaggatacgcagatgcacatcaccgccatcctctggaatcgtaagccccagtgccacctgtacaggctcaccatccagcgcattccatgcaatcgggtgttcaaatttcacaaggaagattcccggctttatgcaggtcgcatgcttgctgtgcggtatagcgatcccatcctgaaagccggttgtcgcctctttttcacgctcacacataccttcaaaataagcattctcatcctttacatagcctgcttcatatgctgcgtgtgcaatcacatgaaaggcttccttttgtgttttcgcttctgtatcaaactgaatatgatgcctgtcaaatacactcttatccataactgcctcctgttactcgttttcttctacaaccggttttcgccagaagccgataatcaatgccgttaccacaatccctgcaagtacacagagaatccaggtgataaagggtatcggctgttcgatatatccgataaaggttcccagcggtgatccgataccgccataaaatttacagcctgtcaaagctaccagacctcctgccagtgcagagcctgccacacttgcggtaatcatctgtagcggattggctgcagcgaagggaatcgccccttctgttacaccgaccattcccatgccgaaggcgcttgtcgcagaaatcttttcagtttttgagaatttgtttttgaaaatcacagatgctagccagataccaagcggcgcaacggaaatcgctgcctgtgtggcactctgcggcacgaagttggcaccctgtacaccgtatttggtcattgtatccgtaaatacagctgttccgaaaatcaatgccgtcttatttaccggaccgccgaagtcaaagccgaccattgccccaatgatcgccccgataataaatggagctgccgcatattgttcattcagtgttgtcagtccgctgtataatgcatccattgcgaatgcaatcggctgaccgatcaaaaacagaacgataatcataatcaccagagtggatacgaacggaataatcataataccggtaagtggctgcacgattttcggccagggaatacgcttcatcccctttacaaaatatcctacgatgaatgcaaccagaatcgcagacaggaaaccaccgcctgtctgtgttcccagaaattcaggatcgttggcaatataggcaccgatcatagccggagcgattgccggtttgtctgcgatggatttcgcaacaaagcctgcgaacagtggaatcatcagcttgaagcctgtctgtcccaccatgaacagcttctgcataaagtagcccatcgctgttttgttatcaaagccccagtttacaattctacccagatcgtccttctgaaatgcaaatacattcgcaatcgccagcagtaaacctgcggcaatacacatcgggaccatgtaggaaataccgctcataatgtgtttgataatcggattttccgttttccccagtgtgatgtttcccgccttgcttcctttttcgccatacagcgttgcctcgtttaatgcacgttcaatcaatgcgttggcatccttgattgcatccacgcttcttaccttcatgacacgttttccagcaaagcgggcacaatcaatatcaatatcagctgccacgatgacaacgtctgcctgtttgatttcctgttcactcagaacgttttccgctccaatggacccctgtgtttctacacgtacagaatccccacgtttcttccctgcctgctccagagattccgcagccatgtacgtatgtgcaatacctgctgcacatgctgtaattgctacaatatgcttactcataagttttcctcctatcaagttctcgtatagtatatcctgtaccttttttaatgtaaacacttacagtccattcagggtgcagtatccttttttcttaaactgatgaaactaatttcactgtaaacggttgtattttgtgatttttcatgtaaaatatcagataatttgctcaatagaataattttatgaaatttttgtccatttatttctactatatgaattttcattttaataagtaagggctatgcatacagcctaaagcatagtctgtttcatcattcaccataatgttgacgataccgattttcatgcctgctatttcgggtatatctaattgattgcggggataaagttcccctttccattcattggattaccatataatgctaaatatagctttgattcattgaaaaaagtcatggaacgtttacccgctcgcatgactctgttttactattccttatgttcgtcgtaatcgtttttagtcagctcttttaaggctgcatcaaaatcaatatccggctcctttgaatcctgtacgtcttcgtgcacttcctcagcagtatcttcctgtgtaatgcctgcctccagatccttcagcttctgctcggccgctttggcttttgcttccgctgcacgtacttcatcctcaggagaaatcagcttaccataattcatcagattgtaaatctgttcgctggtgatggtttcttcctcaatcagcgtttctgcaatcaatgtcagcaaatccttgttatcctcaataatctgttttgcacgatcgtagcattcattgataatcttacggatttccttgtcgatttcatatgcaatctcaccggaataattgcttccgctgccataatctctgcccaggaatacatttccggtaccatcatcatactgaatcggtcccagagaggacataccccagcttcgaaccatagcctttgcaatttttgtagccttctgaatatcattgcttgctccggcagatacttcatcaaacataacctcttcagcaacacgtccacccattaagccggtgatctgtgccatgaagtctgcctttgtcggcatcattttttcttccttcggtgtcatcaggttatagccgcctgcttcaccacgcggaataatcgtaaccttttccaccttgtctgcgtcatccagcttcaagccgataacagcgtgccctgcctcatggaaggctaccaggcgtttttctctgtctgtatatttcttggatttcttggcaggccccatcataacacggtcaatagcctcgtcaagatcctccattgtaattaccttacgtttatcacgtacagctaatatagcaccctcattcaacacgttttccaaatcggcacctgagaagcccggtgtccgctttgccagaccctccagatttgcattcggcgccagctttttgtttcttgcgtgtaccttcaaaatttcatagcgtccacgcttatccggcaggttcactgtaatctggcgatcaaatcgtccgcttcgcagcaacgcagggtccaaaacatccggacggttggtagccgcaatgattacaatacccttattctcacccataccatccatttcaacaagcagctggttcagggtttgttcacgctcatcgtttccaccgcccataccggctccacgctgtcttccgacggcgtcaatctcatcaataaagacgatacacggtgcagtctgctgtgcttttttaaacatgtcacggacacggctcgcaccggtaccgacaaacatttcaacgaaatcagaaccggaaatagagaagaacggtacatctgcctctcctgctactgccttggcaagcagcgtcttaccggtacctggaggacctaccatcagcatgcccttcggaatacgggcacccatatctgtgaaccgctttggatccttcagatagtcgatgatttccttaacctcttctttttcctcatcacagcccgcaacatccttgaagcgaaccttgatatttccttcgatctttgcacgggatttactgaattcaaatgccttattgtttcctcccgcgttcattttagagaacatgaagaacgccacacctgcaatcagcaggaacgggaacacattcatcaggaatttcattaacaggctttccctgtttggatcgcttactgttaaattggtactcttgctttttttgaatacgtctgtcagataggaaacattcttttccgtatttggcacacgaacggtgaagtttacatctttgcctttctcactatacgacccttttacatcaataacggtagttcccattgacatttctgctttggtgaatgtcatggtatttgcctttgtcataaattcgttatagttaaagttttttgtattaccctctgatccataggaaatcagaagcagcataataccaaggactaagatataaggtagaaagcttataaactttttattgttcattcaatcgtcctcctaacgttttatttgtatacttcaggtttcagtactcctatataaggcagattgcggtaatgctggtcataatcaagaccgaagcccacaacaaattcgttgggaatctcaaaacctacataatctgcagttatatctacaacacgacgatccggtttatctaacagagaaacgacttttacatcgcttgcccctttgtttttcaacagacgtgtcacttccttcagcgtgcgtccggtatcaacgatatcctccacaagcagaatcggtacgccctttactgaacagtccagatccttgacaattttaatatctccgatggactctgttccttcatagcttgatacatccatgaagtcaaactggatatccaaatctatatgcttaatcagctctgcaagaaaaggaacacttcccttcagtaaggctaccagcagcggtgccttccctgttttgcggtaatcatcactgatttgttttcctaattccatacttctttttacgatgtcttcctcggacaccaatactttttcaactacgtcgtgcatgcaaaatcctcctaatacagctatctactattttaacacaaatagcgtaggattgttagaaaaatgtgcaatatcacagccaattttaggcaccagaatcacatttcccgcagcattcacaacaaccggccataatttgcgttcctttttgggaattttgcggtctatgaaccagcggttcagcttttttacgccgaatcgaagctgtatggcgtcctgcggctgtgcatttcttatggttatcggccagtctgttgcctgcagagtaaccgcctcaacccctgttccgtgaggagctgtttcaaagtacggggttttctcaaatactgcatgatcgtatacataggaatagctgatttcctcactggtatcaattaccagctttccgtattcactgtatatatcatacccgccggcgatatcgcgtgtccaatagtttgcattgttcataatcagctcccgcagcacctgaatttcatgcatggacagataacagctgcatgtatcatgaatccaggtgatcagcacctgttccagaaaatagctgtccagtacccgcagttttttcagacttccgtcccagctgtttaaaaacgcacggcaatccgcacgcagctgctgcatgcgcatgttttcccgggaaatggtttccatcagcgcttctttttccttttccgacattctatccacaatctcatgccggattctgtttcttgcatagtgatccgtaaggttgctttcgtcaattccaaaaggcacggcattctctctacagtatgcttccagttcccgtttgctatacgccattagcggacggatgatggtacagcccatgatgcatgcttcctcctgtataccgagatattccttcatactgccgcgctcttttgccatgagataggtttccagatggtcatccaaatgatgtgccagcaatacggcagccgcctgatacttctgtaaaagctcgcgatacatacgatagcgctcttctctggcaaacgcctgaaagttgcccacacagggctttgtctgcagtctcgcttcaaagggaatatgaaaacgtgcacaatagctgcgcaccagttccatatcccgatccgccgtatcacgcttcttataattcatatgcgcgactaccagctggaatccttcttttctgcacatatccagcaatgccatagagtccgggcctccgctgacaccgatgatataggttcctttttccagtttcttcatttgtttcatgcggctattatacggtaaatacgatcattaggcaatatgaaaaataaatagccatgtgaatttatcatatcactggtagaaaacgaacacgttgtctatgaaaaaacagatgagggatattcatcatccaacacctgcttttatatcctgaaatctcagacagactgctattctgcttttacaatcagacaggatttcttacaaaagacgattccgtatgcgacgatatctgtatagcctttcttatacagaccttccagatacttcctatcttttatctgccggcatgcctgttctgcggctatttccatatgttccatattttttaccacctttacttcaaacaacaggcctctttctttggcatatgccggaagaacagcaagatcaaacctgccttctcctgattcctgattagacactacctgatagtcatttaacatgcctattaaaacaccatgatagaacctttcattgtaatcaaaatagctgattgactgaaataaaacatcgttcagtactttattagccgctttcacatcttctaccatcagcgcttctgcaaattttatactgttttgcattacctgctgttcaaaccattcacggaagatcatcgtataaatccgattgatttccttgtttggaatcatcaactggtagattcccttctcttgatccgtgcattgaacagctttcagataaccggtaaacagtaaaaagctgtaaatattattaacttgatccaattccctatacgttatattatccttgattgttttttcaataactccgcctgatgccagtatatcgaattcttctctcattttagagcttgcttcttttacgtagcgatagataatatcatttccactcgtattcgcccaaaaagactccggtgtttgtttatccgttttcatcaatttatcaagatacatcaaaacactccacgggttagactctgtccgctagtagcgtaaatttcacagtttccaaactgatagccatcgcgccatgggcgggcagcgcctaccattccttcacctgcccctgatattcatttgcctgataatcaagcaacaaggaatcgatttcattctgcgtgaagccaaatcgctgtttggaggtttcatcaaaaatagaaagtaccttaaaattattcagtccggtaaaaaggctaaagcccgcctgtggtgtcgattctttcgcaatccttaaacagcctgtcagtatccctttctctaaggcatcgtttgtttttaaagcagcactgaatacatttccaaggaaagcaaccatatcatcataataaccgttcaagtaggcattctgtaaagggacatcacgccatgggcgggcagcgcctattcatcgatgagtatgattacctgcttttgataatgttgttccagacatcccgaaatgaatcttaaagcattttgcagctccacttcattttgtgcaccacggtataaacttttcattcgctccttgtcaaattcattgatccgctcacttgttagcaattcatgattatttctaatgatttcctgcatcagataggaaaacattgtcagttgtttttcaaaggtattatttttcatatcttttaaagtaagaaaaataaccggatactgattctgtagtttcataacctgcgcatcttttgtgatatccaatccctcaaacagataagcgctttccttttgtttgatcgaaaagaaataatacagcacgcctgggcgggcagcgcctactcatattcaaggtttttcccgctactagcgcgcctcttgtcggataccaaaggtatcgacactatttcggtgaaatcgcctcggtcttgtatataacgctactttttcattgcatacatctttgataaagttcgttttatcgacataataatattgatgatcaatcatttctttgaaattttctataccgattggcaaagctttcatattatcagctcctgtctgcatagctttattatatcatactctttctacattatatcatgcaggtgggtatgaatttcatgtatgatgaagcctaatacaaattcccttacaacaaagcaaagaagtagatatgaaattcagatagaatcaaattctgcatgatttgcgtttagaatagctaagaaaaggaatgccctattataagcactcccatactaattctttatcacgctatgccatggtcacctcagttatttcgatatggtaagttcccttattctgcttcacagcaagtgtcatatgctccagataatgaaatataacatctccatcaggatcgtcatagtgtactgtggttatcagcaacaaggtattttcatcctgtatcgtcaggttactatctatattggcgattccaatgtgtttggtatcattcgccagcacggtattctccttcatgatggatgtaaaaacggtgacttcattctcacgatcaagtgttccatctgcgtttatgacacaatttccttcataagcaacactgtatccctcactcaccggctgcgttagcgaaaatgacagtatctgtttatctaataatgctttcgtatgggactccattacgacaggttgttgcgttacttctatttttagtttctcacctgcactagagcatccgcataagcagaccatacatatcacagaaacccatattcggaattttaagtgtttttctttgtcttcaagcatcttcatgctcctgtgcttcaaagcgtgaaggttatgtataaccattactaccaacccctatcgttcctcttacacctatatactatcatataaattttaaaggaaacaggctggtaatataacattttcgttgttatgattactttatacagtattctataaatacagcactgagctttaattatcgcaaacgtaatttcacggagtttctaatatctttaagctggcacagtttcctatacctcatccactctggccagtacaatcgtagaatcgtccttacgtcttgtcttttttaacagctccgtaaagctttccacatccgccttcacacttgtctgtgtcctctgattgagccatttataaatctcattcatatatatgccatcggatatcataaggtattcatcccctgcctttacatcaacctggaagcagtccggctgcatctgactgatgattcccacaggcaacgcactgccgttaatttcatatatctgatcatcccgcagcagaaatgtcggacaggctgcggattttgatatgtaggcaaccccctgtgaacggttaaagcagatgacatccagcgttgcataggtatcgctttgaatcagcttgtttatacatttgatggcgctgtcctgtggaattccactgaccatcatacgttggaaaatattcgtaatcaggcgtgagctttgggcagcacgctctccgtttcccataccatccgaaatcatgcacaccacactctgacggaacctgaagatggaaaaggtgtccccgctggaggtgtaggagttttttacactgtccgcataggcatcaatggcaaagggaatatcatcacagacggtgatggaatgatagccgcgcatgaattttcgattgcgaatgtccgcaatctgcagattgcggtgaagcaggacttcaagcagcggaagcagcgtagttcgtatttctccgcgtttgatatttgctatttccacacaaacctgtatacagccctccttcggttcttcaatactcagctcacgcacatcatattgatagccttccagcgccttggcgacacgtaccgtatccttttcgtagccgtctatttttcgtatggcgtctgcattatattgcaaagcattggacatattggcaagcagttcagcctgcacatcactgatctgtgcataatattccgacagggattgaaagatattggcataattctgcatctgccgctttagcatactcgtctgagaaagccggtactcctgttcattttgaagctccgtactcatatgcagggaagctgcattcgccggtacaagcagaacaccgctcatacacagcagcagatatatcaaatcctctgtattatccggatacaggaagcatgcccccagcaacagcagcatggcactcttgcgatcctttttcaaaacacttaaaagaaccgtaaggacaagtgccggcagcacacggatatccagcaggaaatatatcatcagcgccacagtcactgtgatccatgcattgcttgataaagcaatcagcagcatggtaatcataatgacctcctgtgcatatactggtaacagctccacccccaataagccgatggtaaacagcaggatcccccgcatgcaggcattatgcagcatccccttctgaatccactgataatccgcaaacagctcctgcatcaacacaaagctcagtaccggcagaatcacagccgtattgtgcagtccatactgctggacactgaacgccgcacttaacagtgctgtcagatacggcatccactggtataaattctgattcatcaccttaaccatatgaataatcacaaagtaacaggcaaagccaagcgcatagctgtacgccggcagaattcctctggttaacgagcacagaagaataaaaaatacgctgatcatcgcttcccggattgtacgcatataggaataggatacatacagaaatgcaagtgtataactaagcggagaagccagtgtaccaagaataattgaaattccggcacaggccaaatcctccgcatgaatggaaaatttccccttcagtctcttgttcatcaccttttccaaacaaaaccacctctttcatgcgttattgtagaagacatttcgcatggattctgtcatattttgtctgttctgcaaaattgcctgcttttccacagcattcttcatcatcctgacattccctagcttttcaaattgcatttccccgtcaaacaagcgccttgcattagtccagacagtttttcacacggtcctttatttcacggaacagctcactgtcacgccttaaatgtgctttgacatcaataattctggcagtattgatccattttgcatcattgatgaacaaaaccgattccttattcattcccttgattttccccaggcgcatcaaatgacgcttccctttcggattctccttgctgtaggcctgcagataagccgtatgattcccgctcatcggcacaacgaatgccttgttatgaaaaattgttataatcagaccaaaatgctgataaccaatttctgaaatatatgcttcaccaaaatctatgtaacagatatcaccaacacggatatccacaccaagctcaccacagcttcccgcatgacggcgttctctcagattctgttccgacaccagccgcggtatcgcctccttcacactcaaagatgcataatccatgctcttctcctcgatgtagcattcccacagatccttccaatacgccttctctccaagggaaccctccttctgatcctcatcgaccatttcgtataattttttaacttccatttttctcacctcactatatacatacgatagaaaaagggccaaatcctaaaaaatcctgaaaatgcggatattttttatacttaaatccacaaagttttcataattagggaaaatgccgttaatgtcccataaaaaagctttatggcaattcttacaatatggaatcattcacaaccgcattcctattgctgtcacctgaaaaaaaaggaaagtgaattataaaaataatacaaaatataacaccctcagtaatggctttgcctataggaaaaacaacagccatggctgacatccagcaatgaaatcggtgttgctttaacgctatgcgaaacatagaggtgattatcatacacgagtatcaaatacaaaatgtaaataagagaatccaagcactgcaatcatggtcgcagccctgtattctctcattttttattttcatcctgaatgccaaggatttctacagcattagatttgctatttttcctgtttcgtatccggacttttctttgaaaatttccgatacagctttctggcacgcttctgaatggtatttgctatcgacagcaacgggtgatactgcttggatatcatcccggaaaactcgataaacagctcaacaaccagtgcgatgataaacagaacaagaaatcctgtcgctttatttattagatagatgtacgctgtaaagccgaacagcgcagtcaccacatacaaaataatgaccgtattgcgatgtccgaaccgctgcatcagcagatggtgcagatggttcttgtcggcttccgaaaatttatgcccactcagctttcttctcaaaattgccccaatggtatccacaatgggaaccgccagcagcagaatcggaagtgccagtgtcataatcgtggagctcttgaagcccagcaatgagatagcggatataataaagcccagaaacaaggctccgcagtcccccatgaaaatacttgccggatgtgaattatacagcagaaaccccatggttgcccctgccagaatcaaagacatcgtctggatatccagacgtccctcgatcacggaaagacatgcaatgacaaccagaataatcgcagagattccccctgccagaccatccagtccgtcaatcaggttcaccgcattggtgataccgataatccacacaaaggttacaataaaggataccagtcccatatcgatggaaattcccatcggcagacggatcacatcgagtgaaacctttcccactgtcatcaaaacgatggcggcagcaacttcaaatgcaagcttatacttcggtttcagattgaccatatcatcgatcaaaccgcctatgaacatgattgtcccaccaatcagaataccgttgatggtcatatccgtcttcataaaaaccgccatgcacacgacaaaggatatataaatggctacaccgccaatacgtgcgatttttcccttatgtacggttcgctcattcacctgtgcataaatatccagccggtaggcgacgattttcagaaaaggagtaatcagtgcggataaggccaatggaataatcagatatttcagccaatccatatagatacctcgcttttattttctattgtacaagatgcagattctcgagcagaattcccgtaccttcggccacacagcgaagtgcattctccgcaacatataccggaatgtgcagttcattacgcagcagctcgtcaataccgtgcagcagtgcaccgccaccggtcagtacgatacctcttgtcacaatatcacttgctagctcgggaggtgtctgttccagaaccgttttgcaggcacgaacaacatcctgcagactttccgccatactgccctgaatttcctcactggacagggtaatggttgtcggcagaccggttaccaagtcacgtccactgacttcaatcgtttcatgcatgctgcccttccatgcagttccgatctgtttcttcacttcctctgctgtacgatcaccaatcagcagctttttattttctttaacaaatttgataatatcacgatccagcgtatcccctgcaatcttcagggaggtactgcttacgatttcacctaaagaaatcaccgcaacgtcagtcgtaccaccaccgatatccagaaccatgcatccgcttggctttccgatatccagtccggcaccgacagcagccaccttcggctcctcctcgatatacacttttttcgcacctgcacgataagccgcatcacgaatggcatttctttccacactggtgatgttgcttggacagcagatcagaatggtaggacgcttaaacatccccttgatagccagcttcttgaaaaagaagttcagcatgatttccgttacctcgaaatccgcaataaccccatccttcagaggacggattgccagtactctgcccggtgttcttccaagcatgtccttcgcatcctgcccggcagccagacatttctttgtttctgcatctatcgcaactacactaggctcgtcaattacgatgccttcaccttttacatacatcagtaagtttgctgttcctaagtcgattcctacttcttttgaaaacatagtccttcattcctttcgtgcgttcatatttcttccataagaatttgatccgcattttttacagtagtccgcacagattctgaaatagataagaaatatccgtttccaaacataccatgcgctatttatactcaatttcaagcaattaccattataacacaaaatccgaaatgtaaaagtgttaatatgcctttccttttcttaaaattccgtaatatgtatggatgggctttcacatatgaaaatagtaccgcaagggtactatttgatctcagcgttcgttttgccgtacatcagctccggatctataatcttgccgtttttctctacgacgatatgcagatgattgcccagctccttgttgtaaatattgcttccggcctttgcaatgggatccttctgattgaccttatcgccctttttcacagtgatatcggacaggctctgataggttatgctcagatccttgctggtgattgtaacacttttgccgaagatattatcttccttcacatcactcacctcgccgctgaagcttgccagaacatcgaaagcctctttgttgaaggaatagtccatgccctgattggctcggtagacgccttcaaactttgtcatactgtcaaccttgctgtcctttccatcaaaataatcaagaacgacctctgccttgaccgcaaacggctggatgcctttttcttcctcagctgagctgggaagcgagagcaccggcgtggtgtcttccttaaacacggaagtgtcctttgcaggattcttcatggaatattcataagtcagaaaggcagctgcggcaatcagcaggcagcttaaggaaacaatcagtctgcgttttggaaatttcttttcctttgtatagctatacatttcatcacctctagtgatgattatgcccgccccttttttctttatacatcattcttttacaatctgtacgccggtataataatgcttcagtatttccttgtaattctttttctccagcgccattccctgcgccccgtactgactcatgccgagaccatgaccaaagcctctggttgttaccgcataaccgccgcttgttttctttatggaaaagcaggaggagcgaagattcagcttttcacgaatctctctgccactgaagacaatgcggtcaatcgttatggattttacatagccggaagcgtaatgggaaggcttccccacttccttcaccggattctcaaagccgagcatcgtatgaaaatcctcctctgaaataacagctgttttttcatagccgtcttcctctttatcccaatgtgaatccacactgcgcagatacggcgtcctgctgtcccagtattcctcactgttggctgttttcccacatgatccactgaaaaacacagcagaaatcggttcgccctgataggtcatgatttccccttctgtctcctgcagcgccttaacaaccctggcatgcatcttatcataggaactcccccagatctgacgcatctgcttatcgtcgtgataaacctgcgtccgtgtggtatcatccacctcaaagccgcgcttcgtcacaaaggtcctggcagctacacattgagccttcagcgcctccatctcaaaggaagccggcatctccgagccaatcactccctccagatatgtttccagcggcagcttcaggctggttccgtcctgtcttgtaatatgtacggtctgttctttgtccttcgctttttccttatccttcttttcctgctcctgcaccgattccttacccgtattccataaaatcggtgaggatgtgcccatattcagccagagaaaaaaagagacaagaattatggagagtacaaggagaaacttcacagctatcttcaaaaaaatcacaccctctctacactgtatgaaagggtgtgtgcacttattcctcggtatccggatgcagcttctttttaaactcacttggcgatacattatagtatttcttgaataccttgttgaaatagagctggtcatccataccgaccgccgctgcgacatccttgatcatgctggactcgccgcgcagcagctccatcgcttttttcattttcttctcattgatatagtaattcagattcacgccggtttcatttttaaacaagcggctcaaagagctttcattcataccgatgctgtctgcgatttcctttagtgtcagcttgcggttcaggtttgcatcaatatattccataacctccagaatcttgcggcgatagcgtctgtttgattgatccttcatccatgcctcaatctgatcaaacgaggaggagacaatttcctccagcttgtctgctgtttcacacagtcgcagctttgctgttatcgtatcaaacggaaaggcctgccgaatcccccgtgccatttcatttccctctatattatggaaaatgaagatgaaatactccagtaccgcatgcggatcaatttcatgaaatttcatatactccagagtttccttcagcttgtgctgtaccgtatcaaaatccttagcagcaaccgcgtccagcagctccagatgaaaggtcacctcattcatatccagctcctgaaacgcgtcatgctcctcgctttgaatcagacatccctcacccacataaaaccttcgctcatgtgatttcagaagcagctcgaactgatcgtaatattcatccagtgatgcaatgatatccgacaatgtaatggacagatgtatatccagatactgtgtgatatttcgaatgatgctgttgcatatattcagaatacgaagcttttctctgctttcaaacatcaggatgccggaatggttgctcataaaaatcaggtgatgatgcacggcaagcggcatggattcccgtattaaatcctgcagatgcttatgcagtgccgcatggtccttcagcttggttcgatacagatgattgatgttatccacgcgaaaatatgccatctgaaatcccttttgatagggctcaaacaccggctgtgacagtgcttcctgaaattccttacggctcagaatatgctcgttcttggtaagaatcagacattgctgcagctcctttaacgcagattcatattccacatggtcattcaaactgctttccacacaggattccttcacctgcgtgataatgcgttccagctccttcttttccagcgtaacctttaaaagataatcaaacgcaccggccttcatggcatcccgcacatattcaaaatcggaataattgctgagtgcaatcacctgtgtgtttttattgacctccttgattttggatatcagatcaattccgtccatacccggcattttcaaatccgtaataacgatttccggctgcatatccgtgaaaatgtgaaatgcttcctccccatcctttgctgtagcgattacctcacagtcaagtgccttccaatcgatcatgttttttaatgtgatccggattaagcgctcatcatctgctatcagtaccttgtacatgaggcctacctcccctctgtttttttaaacggcagcagcagtgtcacaatcgtaccggtgcctaccacgctttgtatatccatcgaatagtcttctccatacatgagacgaatacgctcctgaatatttccaatgccgataccgctcagcttcttattgcggttttcctgcatatccaaagcgaagcccttgccgttgtcaccaatctctattttcagatattttccctccaccttggcgcgaattgtcagaatctgatgctccctgtcctcctcaaaggcatgaagaatgctgttctctgcaatcggctgcagcagaaatttcaaaatagcacagctgcgcacgttatcatctatattatatacggtttcaaacacatcaccatagcgaagcttctgaatgatgatataatttttcagattttcgatttcctcttccaccgtaacaacttccttgctgtccacaatggtgttgcgcagcagtctggcaagggcggtgattccctcactgaccggcttatcctcattcaggatggcaaggtaatgcagtgtgttcagggtattgaacaggaaatgcgggttgatctgtgcctgcagcagctgaaactgggtttctcttttctgttcctgctcctggtgcacggtatgcagcagctcctgtacccgatccagcaggtcattgaagttgatactcagttcatgaatttcatcacgtccatcatcctccacacgattcattgccagattattctcatccagtgtccgcatggaatacagaatgttatgaaccgggtcatagatgctgtgatatacgaagtaggcaatggcagccagaaggacaaagaagacgattccatatgccaccagcatattacggaaattatggatttcctccagcacatagttttcatcatttagataaaccacataccagggcgttccctcaatttttttatcagacatataataggaatgctgattgatctctacggtggatgcctgtaaatcaatgatttcctttatatcatccggattgcttccaaacagaacctgtccgtttgcatcaacgacaagcatatggcttcctgcctgcgtggattgtgagagggatgcgttgaaggcttcctgcgcaaagctgcaaaatacatagcccagcggctgatcatacaaatcccgaatttcccttgtcagcataatcatctgcgcttcgttatcatatagccagtagccgccctgcttctgtgcctgaatttctgctttatatgcttttaaatctacgggaaagagggttccctcctcatagagcagcttccctgtttcatcatacagctgcagcccctttctgccagcaagcaggtcattgtcatgcagattatgagagaaggcacgccgcattgcggtatctgcaggatagtataaataattccgcaagtaggtggatgccgcaagattatcgatttgttcatttaatgcattcgcattcaaatggaagatttcctcggacatggtcaccatctgtgcagacgcctgttcatttttatcccgtataacagttgtgctaaaggaataatagataagaaaaaacacaatcatcagacaaagcggtacaaagataaaggccagcgtcagtcttgttttaatatccgttctgcgcagcagatttctgtttcctctcagcataacaaccagcacctttcatcatgtatcagctgtaggtcctttcctatctataaataaagcctctacagtccgttgtatacggaaatagcaagcaaaaactgcgctacgagatatcccagacccagagacagcagcaacagcagcagacgcacctgaccaggctttctcacatttgtaaaggtttcaaaacgtacacagctcaatgcccagaagctcagtgtaaaggatagtacatgaacagccagattcattagaaaatattgcatatataacctccataagtttattatacctgtttccacatttataaaagcgtgcctgacatccatgagatggcggtcgcagtacgcgtttacatagcaagtgcttatccatatatcctacagacaatactggtgcaggcttcacactcctgtttttatcccggatttttcacagatgatcactattacaagctgtaatactgcaatcatacaaatgctgtgaatacgagggcttcgcttactcaagccgcgccgtctttagcacctggttcaaatactccatccatttgtaaagggaaggatagaaaagaaaagacataagccgtcttggaaatgcttcctattttacaatcatacaagtatagcgacgctgctcatctgtataattcgcctatttcattctggttacattataccataagatgaaatgctccggcagtttttccttataaaatataagacaagctcctgtcagttttcagatgatattgtaatgtgctatacctgtggggataagcgtgaaagaataaacgaaaggtatgaaataatctaattttcataaaactttatgttcgcgaatggtagagaaatctatggcatatcgttggaaaggctgtccatagaaagctgcattttcacagaaaatttgtgtaattcgcaagtcatgtcaagtatttcctaaatctttcccttataatagaagcagtatataaatgaggtgaagcaatatgtatgagtggcagaagcagattcagattattgttgatgaaattgacagctgcataaaaagctatcaggatgaagcactgacactgcgaaccctttcacaaaagctgggctattctgaatattatacaacgagaaagttcaaggagatatccggtatgaagcttcgggaatatctccgacagcgaaagctggccttcgccctgaaggaaatccgtgacagtgagaaaagcatattgaagattgctcttgattatggcttttcttctcatgaggcgtttaccagagcatttaaagctgcatacggaaggacaccgagtgcgtaccggaaacagcccagtcctgttgttctacgtaccaaaatcaatccgtttgaccgctatcttctaggtctggatgagcttggagaaataaattcagcgaaagctgtaaagacctatttcgtgaccattcccgcacataagttcctgtttatcgaaaaccgggagagtaacggctactgggatttctggcagaagcagaatcagattcccggccaggatatggatacggtttgcggactactggacagcatcaaaggaaagctcgatgatagtggcgggagtgacatcaacagcggaggcggtcagattatggcctatcgcaatgatcgaaacggcagattgtgtgactggggatacctgcggacagagtgttatggtgtccgtcttcctgttcattataccggagatgttccacatgatatgcagctgcttgatattgcggaagcagagtatcttgtatttgaacacggaccatttgattatgagcaggagaatcgaagtgttgagcataggatggaggatgcaatgactgcatttgattttacaaataccggctactgctttgatgatacccccggcagaatgctgtacttttactttcagccggagcgctgctggaagtatatacgtccggtgaaaaaaaggatgcaataaactgtgctgttattttactttttctgaaagcttagaacatttcttattttgtttaaatcagttagcagtttttattctcctgctgcaaatataaaatatctttattcttttgatagtatacaaacagaaccacattttatttcatcataaaacaaaaatgctctactgttcctattgccatacgctgattcggaagccttaataaaaagttatgagaagtgctctctcctttttataggctggtatgcgataggagtttttggcctatgctatacgcaagcagaattcttttatttcctttccacattagaaaaggtataataaatatgaaaatcatttaaaggtgggtgaaaaaatgctttcagagaaagaattattaaatatattagataataaagaaaaagtaaatgttgaatttaaagaagctaaaagaggagtacctaaaagtatatatgaaacttattcttcttttgccaataccaatggcggcttgattattttaggagtaaaagaaataaaaacaggcacagctgtaaattatgaaattagtggagtagaaaatgcaaattctattatttctgacttttggaatacgataaattccggtaaagtaaatagaaacattttaaaggatgcagacgtttattcattaacagtccagggcttagagcttgttattctgcatataccaagagccttgtacaatcagaaacctatctatatcggcagtaatccttatgccggtacgtttaaaagaaattttgaaggagattatagatgtacgaaggaatctgtaaattcaatgatacgtgactcttttcagaacgctggcgataatgagattctcgaatggttaaatattggcgatcttgataaaaacacaattgcagtatacaggacacgatttagaaataataatgaagggcatatttatgaagaattatcagataaagactttctaacaaagatgggtgcataccgctttgataagaaaagaaatattgagggagttacatctgcaggtgttttgatgtttgggaaaactgaaacatttaacgaaatttatcataatgtcaatctggattatagagatgaaaccaatttgtttggtgatatgcgttggagtgatcgaataatagaaaatggtttatgggagaaaaatttatataatttcattacaaaagtgtatcctaaacttatttctgaattccctgtaccatttcaaatgaaagattcattgcaaagaaatgatgaaacaaaattgcaggtagctgctagagaagcattagttaattcagttatacatgctgattttaaggaagaaagctgctcaatattggttattaaaaaagacaattacatttcttattctaatccagggttactaagaattcctattgaacagatttatcaaggtggagtatctgttcctagaaatatcacattacaaaaacttttcaggtttattggatttggagaaagtgcaggatctggatatgacaaaatattagctccctccagagctgaaggctttcaagtgcctgagttgtatgaaaatcaagacatgagaattacgaatcttaagttatggattgtaaagaaagagcatggggcattaagtggggcattaagtggggcattaagtggggcattaagtggggcattagaaaagccaaatcatatattaaatgaaaaagaacagattgttttaaatgttataagagaatttcctaatctaaatagaaagaaaatctttgaaaaaacaaagattcctctaactagcttggatcggtatttagataaactaatagctttagatttaattcagaagaaaggttcacgtaagacagtcagttataatgtcaaaaatactgatatataataaagcttcatacatatcatggaatcgattctttgatttataactgtgtaatggactcaacatactatgaaacatgtaactgatgataactgcggacatcatgaagaacagacaggaattgatcctaaaggaaggtatctataagaaatttaaattcatgataatcatgcactgttaaagatttccagtatagaaaaaggagtgaaagatctataaatcttcactcctttgttttacctatatctcaaagtcaattgtaatcaattcgaaagtgacttacaactgcccctcctcaatcatctgtttaaaagcctccatggcaattttatagctgtgcttacccattcctgcaatttgacccagacattcggatgccgtcacagagatatgacggaaatcatcccgtccatggatattggacatgtgaacttcaattgccggtatcagcgtatgtacggactccaatgcatccttaattgcatagctgtaatgcgtgaatgctcccgggtttagtaccagcggaatcttgcatccacttttctccgcttcaaaatataagctctggaagtaatcgataagtgccccttccccattgctctgaaatgcctcaacctcaaatccgatggatgcaccatattccttcagctcttcgatcaaatcagcgtataactgatttccgtactgccctttgtttcgtattccatagaaattattatttggtccgtttacaattactaattttcgcatattctctctcctaatctacccacggcttctgacttatgatcgtatgaagtacctcgttgtttcctctttttaactcgataacaatgccattcggcattttcagccagttatcccctgccggaagaactgtgcagccccatgcaagacacttctcaaaaacattctcgtaatctgttgtcataagagctatgtgatccagtctgccttccttttcgtcaaaggtgatatcctcattcaattgaatcccggcatgcagccagattttacgattcggtttctcacccagagaaagtctgatcggcatatcaaatacctcagtaaagaatttcacacaccagtccagatccttcaccttacatgctgtatgctctacatatgttgccatagcactacccctttttcaatgacggttcatactttaaaatatacttttcgattccttttacgcaggctaccagcgtctggttcaccggtgttgcaataccgtattttttcccccattccacaatggagccgttgatgaaatcaatttctgtgggacgctttaattccagagactgcagaatagaggttttaaacgttcccggcagtccctcacttgcggcaacccatgggtattgcggatcttcactcttcaatacgacaccggctgcctttgcgacctgaattccttcctgaattgcggctaccgctacatccttaatataatcctcttcatacagcggaccgtaaggtaaacgcgtaattccacacaatgctcctgccgcaacattgatcagcagtttatcccagatcagacccttgatattatcacttacctcacacagcagccctgcatcattgaatacgttgcataccgtttgaatgcggtccgtgatttctccgttcaattctccgatataggtccatttcccctgtacgcctgcggagatatagcccgcctgaatcagtctgccgccaacatacgttttaccgctgatgacattttcagagccgatgacagaagcaatcgtttcttcattgcccaaaccgttttgtaaggacatgaccagggtgttctttccgataacattcgtctgctttaactgctccactgcctgctttgtcgcaaaggatttcacaaggacaatgaccagatccgcctcaccgatcgtatcggcagttgttcttgcgtccaccctgacataccagtcttctttttcatttgtcatatgcagaccgtctttgttgatcagatccacatgctcctgccacatatcaacgaaatggacatcgtttccgcccatcgccagagttccgccaatcgtactacccaaagcaccggcacctaacattactattttcatattccgcctcccggtctacttttcttccaaagggaagaacttcagaatatggatggcaaagacaacgatttctcccttttggttaaagatttccaattttgaatacgttttatttgtttcttcttcgattctgtcaacggtatatctgcaggtcagcgtatctccgaaatataccggattgataaaacgcagcttatcgtatccgtaggatgcggaaggaaccggtgattttacctgttcctgaatttttgtggatgctgtacatccgattgcaaatgttaagataccgtgtgcgattctagtgccgtacattgttttcttcatgtattcctcattgaaatgcatctgactgtaatcgcccgtcaagccgccgaacagtacgacatctgtttccgtaatcgttttttcaaatactgcgctgtcccctatttttaaagggatatccacttttgtgatttcttttttttctgccatgttttttctcctttgtaatttgttatgtaatcaaaaactgactccatcctatgcataccaggcatagaacccgactatgacctcatatgacttgcgcacagcccattcatatttactgattgataaattcgttatagatattcattttttcttccctgaaaatacgtgcatccatttccttcagatcctctgcaatctcaggtacaaagcccatctgatcgatgacatccttctgtacatcaattcccggagcgatttctgtaagaaccaccttaccgttcatcagcttgaacacagctcgttctgtaatgtagataacttcctgtttctgcttttccgcctgtttcgcagagaaggtcacggagctgacattctttatcagcttttcaaacctgccttcctgctgtattgttatttttccatctctgatttctgttaacagcttaccggcacgcagggttccgcacagtaccacttttttacttcctgcaacaatattgacaaagccgccggttcccataattttgccattgaaatgatgaacattcacatccccgttctcatccagttcagcaaaggataggaatgccacatccagaccaccgccgtcatagaagtcaaactgtgcaggcatatccatcaccgctcttgcattgactgttgcgccaaagaagattccctgtgccgtagcaccaccgaccggcccggtttccacggttaacgtaaaggcatcctgaacaccctcttcacgtgcaacatttccgattccatccgcaattccgacaccgacatttccaacatatcccggacgaacctccatcagtgctcttcttgcgacaacctttcgctgatcaagcggcagcatcgtcaccgcactgtcatcggcgatataatctcccgaaaagaacctgtcagaaccgttatataactgttcctgcttctcctccacaacgattgcatccaccaggaagcctggaatttttacgcttttcggatgcagggtacctgcttttaccagccgttttacctgcaggataaccgttcctccgttattgtgaaccgcctgtgcaagctggagaacatcgatataggtgatttcctcctccatggatgcatagccttctgtatccgcagtcgttgcacgtatcaggcaaacatccaacggaacaaccggataatacagccattcctttccatctacgttcatgaccctgatcaggtcttcctgcgatacttcattcagcttaccgccacttactcggggatcgataaatgtcccaagacccacatggctgagaattcccggctgtcctgccgcagcggttcttgccagctgtgccatgatgccctgtggaaaattatacgcttcaatcttgttctcacttgccatttccgcaagtcttggtgactgtccccaatgtcctccgatcacacgcttcaccagaccttccagggcgagtggtgacatgccgcggtcatttcgatcccccaatccggtagaatgccacagcgttaaatttttcggacagccagtttccacataccgctcatgcagggcattgatcagtgcatagggatcaacgattccaccgcctgcaccggaaactgccaccgtatcctgatccgcaatatactccactgcttctctggcagacaatacttgcggctttgttccattcctcttgatttttgacatatccttatcctttcctttatatagaaattataggaattgtaggaaaaaaaagaaactgtctattccgttgaaatcaaaaattatcttgcttgttttcattcgtttttctataataaaagggtaatacaggtaactatcctgctttttcaaaaaattatattgctaaatttggaggtgtcctatgttcttatctgatattttgaacgaaaaaaaacaatccaccccagtctttacgaaggagccgatcatatccagattgtcccatagcttcaatgatgcacactggtcctatccctaccatgtacataaacaggaaaccgagctgatatatttttcacagggaaaagcaagctaccagattaacaacgagatttttcatgtttctgaaggcgatctgctgattgtgaataagggctgtatccattccattacatccgattatgaggatccgatttcctgctggacgtgcgccattaccgattttacaatggcaaatgcaaaagctgcggactgtttcttatcactggataaaaagccgtatgcacataccggagaacataaaaaaatcattgcggatatctttgaaacactggaaatgttttcacaacagaaaacacagtcctctgcggcaatttgtaacgccttggcaaatgctctggcacatatttactttcatatctttcaaaatgcagttacggacaggaagaaaaagaagtcaacctttgcccaggatatcctattctatataaatgaaaactatgcttccgatatcacgttaaaggaactgacagagcattttcacatcagcagtgattatatttcccataaattcaaggaaacctatggaatctcaccaatcaattatgtgattgaccgacgaatcagtgaagcgaaatggatgctgatcaatacgagtgattccctgatttccatttcctctcaggtgggatatgacaatacgactcattttgcaaagctgtttctaaaaagagtcggctatccccctctggaataccggaagcgctttggcatgaagataagcagtgaggaatagaagggctgtttcctttcgttttgtggtttatcagaaaagaccttttctcagatggaagggaacaggattggaaaaaagatagtatgttctgttattactcccatggtggtggatggcgcaattacacacaagaaagcttcatcctaatcgtgacagcaatcgcatgtgccagggaatagaccacgcagtgttcaaatatttacatacaaaaacggataggtgccgttgcctggttctttcttactttaggatgtttgcaaaagggagacttcaacttctattgataatacaatcgtgttgaagtctccctgttttatgtttacccataatcgggaaaaaaccggcgtccctaccttattcgttttttatttatgcagcttctgtatgtgctttctgtgctatcgtgttctgtaatcatacatatccccggactggatgtatgcacacgggatatctgctttgacagcggttggcagatacgttatcatatattccatacccggttcctccagattaaagtgtcccataccgataatcgctttatccatgcccagcatactgctgtcccgaatgtattccgccagtgtaaaatccactacttccatggtgagataacagttgatattttcctgatcagcttcctgaatggaatctctggcatctcccagtatatgaaagggaatccttattttttctactgtgctgttcttgtttcctatgatttttacaccgtttagctgcagtttctgaatcagaaaatccgcaagctctttgactgttgtttttggtattgtgaaatgcaatggatgatgaatatcctttgtaatatattgcgtccagcccagtttatccgccacaccataaaaaataccatcagtatagctgccatcttccatcggtatgccggaatgaatatagtcatgatctctccagacaacgattcccgcctcatcgagcagcttcttctttgcgagaaaggactggttgttctcttcctgcagccagtctgtatgatctccgtgattccaaaacaaggcttcatgtgcaatgattagatttgcgccgcgctttgccgcttctcttatgacatccacacttgcccagcaggtggtgatgatgcctgtacattcctgatgagggtttccatacagaaccttatcccttgttgtctgctcatcaatctgcttcccttcaaatactcctttatgatactcttttatatgatcaattaccgtttgtatcagcataaaatcactccttttctatgtttatggttccagataacgcttttttaaattcctgattcttttctcactcataccgtattcagcttcaaaaaattcctcccagcccggataccgcttttccacctcatcaaaggaggagcgcaacagcgattcatgtacactgcagcaatgcaccagcatatctctggtatctccctgaaatccaagctctttcgcatgacgcagagtatccggtagaatatacgcattactcaacagatattcctgcataatcacatcctcttttacaccaagcattttctgaagaagtgccgcgagtacaccggtacggtccttgccggagctgcaatgaagcaaaacagctccatcatccgcttccatcagatttagcagaagtgccaatgcaggattgtgaaacggcagaatccgatatccttcatgtataaaggaagctgccctttttatatcctcgacagttgagtttttatcaatcagcataaaaaaataaaaattctccagtccgtcccttgtctttaacgcagacatatgatgtgatacaaacgcatcgctaagctgataggcatgggcacagcactcctcatcacttcgcaggtcaacgatatgacgaataccgcattctctcattccgtttatatcctgcaccgtgatcggtattggagcaccgcttcgatacagcatgtgattcctgatgtttctgccatccgctgtttttcccgctactctgcgaaaattcggtatcgtgatcctgttcgcttccatctggtcaacacccaaccttattcatataataatgaatatgaaaaccgtcatgtaaccagacagcttccgcatccttcatgcgctcctgcagccagggcaccatggctttcagtccggcgcgctccactgccgcatggttaacaactaccattccaataccatgatccagtgcatactgcgccgcatcatagcttgtaatcccatcatcgctgacaatgaccgcatccgggtgaagcggcagcaattcatacaaatcggtggcagcacctgttccgatggcaatacgccttatatgcatatccgtattcccgaatacatataaaccatcctcatgatcaccatgcaatacacggcaggtatgccttgccagatcctccagacgcatttcaggaatatccgcagcctgataataggaagcctgtggacgctgttcaaacgggaagccaagcagggccgcccactgatccgcaacaccgtaggtacggatacagtcccatacatcatgacagcggtatacactgatcccgtactgatccagcagcctgcgcttgctttttgccgcttcatatgcagctgtatgcatttgcgttgagcattgataaaacgggttttcatgcgtaatgatcatatccgccttatgccttgcggcttcctgaatcgcctgcatggtcgccacccagcacacgccaacggtatgaatctgtgcatcttctcttccatgcagcaggtgatcccgtgttttaaaatcagatcttatccatgttccttccttctccagcagttgtataacatccattaccttcataacaaacctcctttctgaagcctttcaccgtttaccgcccttttgaacaaacgccataacggaaataaagactctgaagcagaacctcagagccgccggatgctattcatcatcaccatccatagtggaagcacaacgtaaggcatttacataaacgatctggtttttgcattcctcaagtatctcgcttatacgcttttcactaaacggcacatcctcctgcgccagaaccatgctcatcgccatgggcagattcatcccgcataaaacatgcacccgttcactgatatagggataaaatttctgatacacacttccccccagcaaatccgttaacacaatgacctcatcctgaggatcaaatgtatcaaacagctcctttaccctgctttccagattctgttccttatcctctgcatatgcattgatatcgtagatcgtctttgccttattcgtaagaaaatccacggtatcctttagtccgtatgccagataatgatgtgatgcaaaaataaaccttctcataataaatctcctatctcgccagcaatccgttcactttccccaaccggtgtattgcttgcttttgtttcgtatgtttttccatattcctgtgcttccataaagtatccctgataatcattcgcatagccaatcaacagaaaatgctttgttttacattttcttctcagctgcaagccaaaggtggacgccagctctccgggaaaggtgacgatcgtaagatcaccaagatggagaacaactccacgcacatgaaattccactttctcacattgcagcttcttttccagcagtgttttttccgaggtggcaagcttccattcatccagtgaaatattcttacgcgataatacctcttctgcatcccgtatacccttttgatactctttaaaataccatgtgttatcataggagacagtgtgatcatagcttactgtctgcacatgatgcagccccagcttttcatatggccccatattgcgcagaatttctgcaataccgcttcctacacggtccagctccgcaaagtcatttccctgccggtactgacggttactgatgtctccgctggcgccggtaaaggtataaggggtaacgcccagatcctctttcatcagggagcgcacctttcccacaagatctgaactcacaagcatattctccacacccagaacggtcgcatggcagttgaaattgcacatggcagcgacaaccgtatctccatgtataaatgtaatgatggccgcatggtcttcaaagggcagatgtttatccgtccgtttactgtagtatccgtgtacctttcctgttgtaatgtatgcctgcacctcacacagctgctgttccagatgctggatactatcagtaatttgctcacagacatatgcaaagtattccggattatccggtgtgccgaacaccgtcatatcatccagtccgtttgcgccggaatgggtatgaattgcactgataatgatatgatcattttcaattgtgagtattttttgtatcttatcttttataactgccgctttttctccacccaatgtgatgacatcaatactgataaagagtagtcggacaccgtcaatttccagcaacagagaaaccgcaaggggatgatcatgaatcccctttgcagtatatttcctggcttctccgacataaccgcataaatgaacggcacatttgggtgtgatatcagcgacacaggtcgcagccttcaatatcagtcccttctttctaggctgtgaagatgccggtggcagctccgatcatggatgccacgatgatgaacagaatcatccaggtcattttcaccttcttcaccttcatgaagtaatatataattcctacagcagctaccggtaaaagtgccggcataacaccgtcaatcagctcctgaaccttcatgacgacatctccgtttttaaactgcaaaccggtgctgagctttacgacggtcgcaaccagagagccgaccacggtcagaccgagaacggaacaggcttcggtaaagaccgttatctgtttaccgaacttggtgataacattgacacccataccgtatccccactcatactgaagaatacggactaccaggaacacaaaggtaaatgccgcccataggaagattcccagtggatttccctccattcccatgcttgccgcaatggatccgaaaattgtaggtatcattgcccagccaatggtatcgccgataccggccagcggtcccatcagaccaaccttgaagtcgttgactgcatccagtgaggaaataccgccttcatcctcaatacccagagctgcaccgatcacaaacggtgaaatccacggcatggtgttgtagtaacgcatataattcagacaggatttcttcaaatcctcatcatccggatacatcttccgtaagcacggatatacggaaaacaatgtggaaggtgccagctgtgtttcatagttgaatgtggaaataccaatcagccatctccatgctgccttacgcaaatccttttttgttaaaaccttttccttactcatcttccaatcctcctgcgacagcacctgcagctgcagttcccgccttcatctgattcttgtaaatttcatatgcccctgcaagtccgattgccgcaataccaagcaccggaaccttcagataagctgccagcacaaagccgaccagcaggaaggaccagtattttccaagcggcatatacattaacagcatcgccataccgacaccgggaagaacaccgccggcgatcgttaagccggtggtaaaccaggcaggcatgaaatccagtatcgcattgacaactgtaggtcctgcgacaatacaaaccagaaccggaacagcggagcacagaccgtagaagaccggtgaaattttaatcatattcagtgctgactggaacttaccttcttcgataagagatgtttcctttctcatcaggaagccgttgaaaattttgtaaataacgtcaaagtttaccccaagcatggcaaccggaagaccgatggcaagacctgcctccatgccttttcctgttgtaaccgcaatcgttgtcgcgatgatggccgcaatcggataatccggcatggaggatccgcctactgccacgacccccatagacatcagctgcatggtagctccgatgctcaaccctgttgtcggatctcccacaaccagaccggtgagccagccgcagataatcgtattgaatgcaaacagctgtgttgttacggtatctgtcattttcagatacgcaatcagtgtgataaagacaatctgtagtattgataattccatcctttttctcctcctacaattccattgcgtgtgacagctttacagctttatccgttgttgtgaactgcacatccacttcgcatccgttttccatcagcttcttataaattggcttttcctcatccttcacagaagctctggagctgaccttcgttccgctatcgcgatcacgggtaataccgatgacgattctcggaatcttctgtccggcttcctgaagtcttagaaacacccccggatcctcacataccacaaataccttgtgatcatcatacttccctgccttgaaattcttcatggctgtttcctctgtgatgatcgagcatgccatgccggcaggctttccaaggcgcatgctttccttgatgatcggatcatttgccgtacggtcatcgatcaccatcacccgctgagcgccggactgcggtgcccacatggttgccacaataccatgcagcaggcggtaatccactctgcccaatacaatactcattacatttcctccttcgcatgtcagaatccgacgcatgatgagttctgcgtctgttctgcttcaccattcctctagcaattcccatgccaacctttcaaaaaactttgtttacaggttttttcaacaattaaggacactatattttaaaacttaacactaggagttatcagtaatcgcccatgtaggaatcaatgaaaacggatggaattatcgggacgattacccctggcgcctactgcatgtttcgaatatagatacagatatactcaatttcctcaatcgggatggaaacactataatacttttccactttttcaaatgcggcttttatacaaagaataaactcctgcatttcacgactgcattccgcatagcttttcacataatcctcagccccctcacgggttaccagacgttcaatcagacagcagacatgcacataaagaccaaagcacatattatagctgaacatcctgttcatttccttctgcagtcggtcaatcgcatctgcgacatgccggagcagcttatccggattcaggatggtcagatttccgatgatattagacagggaaaaatttttcaggatatttcttcgaaactgctccattgcttcctcattgagcaggtctttgaaatgaatcgttaaaacatcaaacgaattgttcataatcagctcttccaccggtatgaattttatgttgtcaatgttaggattcagtgtaccgacaatgcatacgacctcatagcggtcaaagaaatcatcctccatgcggttctccagcaatgttgaataatcataggtaagcacacgtacaggaagatttttcggaagggaatcctccagtatcgttttcagcttttccgcagttccgataccggtggcacaggaacataaaattgctttttcccgtaccttgctttccaaaatctctacatgcatgtcacacgtttcccggtatgcctcaaaaattttcttcaaaggtacatccttacggagtgcgtctccaatctgcagtgccatccttgtactgacatcactggcaatggcgacatttgcccgcgatatatccgaaactcccctgtgtatctcctttagactgcccatatcaaccagcaatacgagatcgcgatattctccccgctttctcagaaaatcattcagctttttcacgatggtttccgtagtcgtatccagcggcatatcaatggcatcatacacatactgatccagcatctgatttactgcattcgctatggaggaggcagtcgcataaccatgtgccagaatgatgccgatacgtttattgatgtctttgctgcggtgatacatatgcatgattaaggtgaaaatcgccgcaataaaagggcgcagttcaatgtcaagatgcagcttcagcacctcactgatttccgagacaatggcatattcccgcatgaatttcttttctatgataccggtaaaattatcacattcctcagaaaaggtatcaaaatattcctccatctctctataggactgcatacagtcacggatcataagggacatggaatatatctcgttcgtctgaaaggaatacccgtatttttccgaaatcatttccacaatagccttcagtgacttcataatatacgtattcgtcgggtctttgatattccgattatcaaaaagaaccgaattaaaataatgctccacatccacggtgcatttctcgataaacttcggcatcagaatacggttattctgtagatccctgaggtgtccgagcagtgtcgcaaacaatgtggtctgcggcagactgtcggatgcatgctgcttcagctgatccagtgaaagcatctgatgcctgtcgaataaaatgctgtttcgatcaatgtgatgattagaaataatcttacccggcaggttcagcgtatgaatctccagtactccttcttttttgttgtgaaacagtgaattcatacacgttgcctgtacaacattgaacagctcaccgacattccctgtatatctggcattcaatagtgcattgaaggcagtattgctgatagtgatattcctgcgcattttcttcgcttcgatatccagtgcctcaacaaggattgaggtcttttctttgatgccgcggtcctccagcgacggtatttctatacgtacgggaatccttcgcagcagcgtttttaacagcaccgtttccggatcctcggttgtcgcaaataccagaagcactgtactgtgatactgatgctcgttgtctcccagcatgcggtaattgccgttatccataaacaggaacagcttttcctgacattccggacgcagacagtgaacctcatccagaaacaggacaccaccctccgcagccttgatcatccctacattatcacattccgcaccggtaaaggctcccttcttataaccaaacaggtttgcggttatcagctccggattgtttgcatattcgctgcagtttacatgaagaaaggcagcgttgtccttgaggattttatgattgataccatattcgtacatcattgccgcaatgctgctttttcctgttccggttggtccatacagcagtgtcggaagtccgtgcggcggataggatatactggctttgcatttgtccacaacatcacgcagagagcccttctgaccgatcagtttttcaaaatcggatatattctgtccctgaatgattgttcttagctcatcaaaagaggtcagcaggttcttatccacccgtatggaatatttttcttcaagtgcctcccggtcaagaaacacaaccggacgggtatttattttgataaatgttccatcattatagtattcattcagatactgtgatatccagtttctgctgagtcccagctgtgtccccagctgagaagcattgttcagcttatacttttcatgtatcgtattctctttcacaagcttacgcaaattgtcttccatgttacctacagctccttaaatgacaacaatgtatgttgtttcagatattctttaacttcagcatcacaaagtaaggcagtatccagacagcggtttacagtcagcgatgatgtacggatcacatcataatccagatagcccggatgaaagacaatcaaactgatacggtcactgtagttcagataggatttaaaaaattgcacaaagggcagcttctgcttataaaactctgtgttggtgtaatctgtctgtatcccctgccagcgggtatcctcaatatgtccttttatatcgattccataagcatccgcaatatcgcagatggctttttctgttgtccctgtgcataccgcatgagcatctatataatccggtaatctgccgcagatggacaaaaactgttccacctgtgctttcacttccacaacggtatcctcatatacgaagttatctattccctcttccatttctcttcttctgacgcgggaggataggaacttcccatccatattcaaaagtgagggaatctgttccggtctggcacaggggcttcccagaatcagattgacatgaagtcctaacgtgacaatttcttctctgatcatatcgaaggcttgtttcgcataaggcatattgctcatcagcccgatgtttttcacaagacctccctggaatgccttcaaaataccgtagtttacagcttcactaaatccaaaatcatccgcacgtattatcattttcatatccaacacctacttctctatattaaaaataacgcaatcctgcatggttgtaaatgaaaacgagatggatagatatggaaaaatgtagaatagtgttaagcagagtattgatagtgtcgttttaaaatacatagtgtctttatgcctactgttaatcgttaggtactggtgaaattattgattttatattaaataaattaacgattagcatcataaaatcagcgataaattgtctattatcagcgatacatagcggtaatctgcgatatatatagaaatcgacgataaatgtcgataatcaatgataaattgccaatacattccatataaatgaggctcgggcacggcagatactgaaagaaatgacagataagaagcttattgtatcgctcggctctaatcgcaaccggatatatccgttatacgaataaagaatgtgtccattccatcatttgctgtatcttataatttataaaataagtatgtataaacattagagatgtcatacagatatttaaagtcaaatacctttgccatctcttttcactattcctacttagaaataatgggtttcaaacttaatgccggaaattcagaatagccatataagaaaagatggaaaattcgtttaataattaaatggaaagcgagcccaaacaaatgatggatataaaaaagaggaatcaatgttcctcgtgtatatcatatggctgttccttgtgaaaatacatactggatgcagataaaactatcaaaaacatcagaccggtttgtacccagtaaaccgtgtaatccagaataccgtgaatcagtatggtaagtatgaatgcagatattaaagaaaacagtcgtaagtcaattcttcgctttaacaataaatatacttctttcagattacctgcaaagtagatacctgccagaatgacaccgataataccatggcttaaaatcggatccagatagatgctgtgcgcatgctgggttggatgtccgtgatactgcttatatatatggaagtaggtcagcggtccctctccaagcagcggatgcgcctggatacccttgattgccgtttcccatatattactgcgttttgcgaaatcctgaaaaatcgttgcccgctgcatcagctttggttccagcagcaacagcagaccggcaccgccaattcccgccatggatgtggtgaaatagataaaccgcttattgatcaaaaacataaacggaatggtcaccacgaagggaatccatgctgttctggagccgctcagatatagggcgaacaggttgcatacgatggtaacaacgtaaaatacaatacggcgcagagtcttcacctgcatcattttataaacacagatcaatacaataaattcaatcatcatcgcataataatttgcattgaaaaaggttgaattgatacggtccttcggactgttttccaccttcagctgaagaaagctgtaatttaaacggtctatgattctgcaatattccatcatcgcccagccaaaacagaaaagggaaatgatacagcaggcgtccatcagcaactcgaataagcgcttattgataacagtgcggaaataaaatataaacagcatcagcagcaggattccgataccgcagacaccgcccagcagattaccgctgataaatgcaattgcagaggtcagtaagcagaatactatcataaatcctgattttggcactgcctgaatgattcccttcatccttcctgttgcacacaggtaaagaagtacaccggcaatcgccagcaatgggaattcaaacggcaggaatatggaacacacaacgaacataataatatattcatccagtgtgaagttatcaagtttacggtgcagaaaagcggaaattctctccatctgtttccctccattcctaaacaaagtaaacctattatagcattgcggcaaaaaaatgacaatttaataatgactaccttacaaaactggtagagaaaaccggcttattccgccggttaattgtattcattcagttttgtagtcgtatcggctattttagattccagctctaattttctgttttccagtgagctgatactgctttccgcagcactttttttctgttcagcagcctgtgtcttggtattgtaattagaattagctgcatctgcagcggattgcaattcctcataagaagtgaaatttgtccctgctaatgcactttttaaggcattcagagcattatcatattgtgctttcttatcattatcttcacttgattcataatcctttacattattaaaagcttcagcatatcgttttacagtattagcttgaccagttaattttgatgcttcatcaccaagtgatttatatgagtctaattctgcctgtgcatcagctctctccttattcgcagccgccagatctttttccacatccttcagctgagattcatactgatccagctgtttctgcagctgagccgcttctgcctgattggtcttgatttcattctttttctcttcatcctcgtcatcacccggattggtattcgtttgcttattgccttcgttctgttccttatcctttgaaccagtaccgcttttatccgttgtcttttccttatcatcacttccgccaaggaaatttgacaaggcatatttcacaccgaaaaatgcgccggcaatgatacagattcccacgataccgataattacgtaggtgatgattttattcattttcgcacttttcccaggatcgtcttcatcttcttcctcatcgtcatcctgttccagcttgcgttttgcttcctctttgcgctgttttttctcttttatgcgggccaacagattatcatcgtcatcctcttcataaatttcttcctctgcatcctcttcctccacatcactgtcatcatattcctgtgcgtccattgtgtggaacacagcagtacggtcttcaccgaaaatctgtgtctgatctgcggaagatgccttgtttctgttattcatgataaccagtgttttatcataggcaggatcgtcatcaaagcctaccctcgtctgatcaagctgtgtgtcatccacacggatatccggaatcccaccctgctttaccgcttccggccgtttaaaggtaccagtttcgctgatactgtcaaagatgctgctgcctgctgctgaggactcctgcttggaagcatagatccttttctcctcttccttctgttttttcagctcctcaatcttctttctcaattcattatcctgactgtattcattgatcataccggataaatcaatatcttcatcatttccggctgttcttcttttatcatccatatttaaacctccaacgtacttgtatcattgtatataatctatgcgcaccgttttgtcgtttttccttattttaatgaaagagtgctcatagttctcctacgaacactccgaatcgaatttctgctactcaaaggaggagagagaaatttcgctacgtaagtcacatatccttatttcattggctagatgaatatatgcaatcttacggcataattataacacctaatcacataaactgtcattttaaatcttaaaattaacttaattttacatattttaagactatacttttccactacgtgatatttctattatatgtaatatatcatacagaaaaaaagcagcgctctgctgcctatgcgtgcttaacgcgatcatgctcctctgcgcgctttccattattaaagcgatcgactgtccccaccaggtaaccggtaatgcgtcttattttttcaaagccctccggctgcaggtgatagcccaatcctacttcctcaccatcaaagctcagctcaacggatgatatctccttctttggattattcttgcgtatatagctgatatacgcgcgggcttccttttcattcacctgttcatttgactgaatttcaattccatcaaccataatctgatattccatatgtaagctcctcctcataattttctgataccattataacgaagcagatgcttccttacaattattacgcctgacaagttctttctttagatcttgcacataggtctgctgcagcttgtttagattccaagccatgcctgccaccaggcgcataagcggattatgtatctcaatacgctcctccaggatcaaacggcatcctccatgcgcaagctcctccagagtaccagtccattcaccgctgaagcgtttgttttccatatggaaagcatatcgcgtaaacggctttttttctgttattgtaaatactgtttcattaccattcggatagatttcacgaaaaaccgtatcactatcggtttctatacattttaagtcacttctccatgcatactgcgttgtatctgtcataaccgcccagacagactctgtgctgtatggcagctctgttcgaaatacggaagttttcattctgctcctccattgcgtaccatttttattttattaaacggaaacaggacatagacatcctttccccgtatatcctcccgcttgaatggtccgacacggcgggagtcataggaaacaatacggttatcccccatcaggaaatattcattatccttcagtgtccgctttggaaagtcctctgtaaaattattgccatgcctgcgaatctgatttgcataagcattgtcaagataaggctcctctatcggcatgccattcacatagaccacatcatcctttgcataaatcgtatcacccggcagaccgatgacacgctttacccagttttccttcttttcttcattgtatactacgactacatcaaagcgttcaatatcctgaaactttgcactgaacacattcatgaggccgatttctccatcctccagcgtagggtccatgcttctgccatccacacgcaccggcttaacaacaaaattggttaacagaaagatgcatacaaagcagatgacgaaggttttcaccaagtccagcagctcatattttaaacctttcttttcttcctttttctttttgggctttatgttttccgttccatcgatgactgcctggaactgttcttccttattttctttttgatccatgatactctccttccttaacggcatggtttaattatagcactgcttttttaaaacgaaactctttttttaaattgttaagaaaaccttttgcctttcctttgcaggcggcttcacaaaggtgaacatttccatttttcaaaatacataaagaaaaccgataatcatttgaactgcccctgtttatccgctataatgaagttagatagaaacatgtatacggatttataaaagctgggaaaggaggcggcgcccatgcctgatcagaatcagttctgggagagtctggataaataccgctatattctcgattctcttccaaaccctgtcatcgtcacagatatggacaaaatcgtacgctatatcaatgttgcggcgagagcgattgttccccctccttatgagaagctgttgaatcagccctgcagtaattttcatacaccctactgtcatacaaaagattgctgtatccaacgcttcctgcgtaatgaaaagggtgccatccaaagcggtcccggagatattataaatcgtgtcgatatttcctatctcagagatgcgttgggcaatcccatcggttatatcaatgtatccacggatgtacgggagctgatggaggtgcagcgccagctgaaaatcagccaggagcgctatgagattgctttacagcaggcccgcaccgcattgtgggaatacgatatcagggagcataccatacagcgtatagataatgtccggggacaattttctgaaatatttcccaatgaaggggttattgaaggcgtgccggatgctcttattgcgcagggcattctatttgaggattccatcagggaaatcgaagtcatgtacagcaagctgaaggaaggctacaaaaaagtttccggacagctgcatatgcgtaacagaaatggtgaggaacgatgggtggaaatccgctgtacaaccattttcgatgaagcgggaagagccattaaggcaatcggtatttcaaaggatatcagtgaacagaagcgcttggaaagcagctaccaaaatgaacggaagctgcaggaaatcatgaatgcaggattcctgagtgtcttcgaagtaaatataacacaaaaccggatgattctgatagataaggaagccgcggcaaaattgagcagtccgccggaggaaggcgtgtatgatgaaattctgcaggcagcactatcgaaaatacatccggactttcagaaaaaggtctacgaaaaaatgaattgcagggcactgcatctggcgtatatgcgtggcatacatacatgcaatgtggaataccggctgaagcgaaaaggctgttaccactggatcaatgcatccattcagcttttgaaaaaagatagcagtgcggatattttcgcacgtgttttcctaaaagatattcaggcacaaaaagaaaaggaagaaaagcttcaaaaagaagtgcacatcgatgcactgacaggcgcctataatcgtaaaggaattattacacatatcgaggagctgctgcggcagaatcctgaagcgatcagcgcatgcgtatcactggatattgataatttcaaggaggtcaacgataccttcggtcatttatacggcgatgctgtattatctgaaacagcgaagaaaattcagaagctctgtcgaagtgacacgctgataggacggctgggcggtgatgagttcgttgcattctttccccgtttacaaagcgaggaggttctcatgcatgcagctgaacgcctgcaaacagcacttgtgaatacctatacctcgggaagtcacatggtgaaaacaagtgtctccatgggaatttcattttatccacgacacggcaccacctttacagagctttatgataaggcggatattgccatgtatcattgtaagcggaacgggaaaaacggatggacggtttatcaggatacgatggagcgctgtcagcaaatcatggaaaagccggattccgacaatatcggcgacatgcagctgaataagccttttgagggaaatatcggcgagtatattttccgcattctctatcgtcgggagaagacggatccgcaaaccatgcggacggtactggagcttatcgcccaccattacgacatgcagtatttttatgttatggatttcaacagggaaacccaaagcatacagccgctgctttcctggagtgaagaggataagagcctgtatgaattgctgcagctggatgagcagaaagcagcattggaatttctggaaaccattcattctgacaatgaccgtatactgtttctggaaaattgcgggaaggactgttttgatagatttccaaaggaaattctgaacaagctagctatttttgcgctggttcacatgagtgtgccggtttccaatcaacacgatatcctcatcggtcttgccaataccaggcatacgcacagcttcagtcgtaatcagcgcacggatattcggacaatttttgaggtaatcgtcaccttcctcaaagatcagcagcagcgtgagcagcagaaaaagtataccgacacgttgatttcacttttgaacaaccttggaaattccatatatgtcattgatccgcacagttatcagctgatttactttaaccagagtcttatggaaatctttccgaaattgaagacaggtgaaatttgtcataaggtcttcagagaggaagatacaccgtgtaaggattgcccgatacgtcagctttcaaagacagttccctctgcctccacagatatacataatgcgaagctgaatgcggatattcaaacgacagcagcctatgtggagtggtatgatcaacagaaatatgttctattatcaggtgtcgatgttacaaggtataagaaatgacagttatgaaagaacaattgatgaaacataccctgctagaaaaacatattattaaatggatcccatatttctatgatggtcattctataaaaaatattaaatgagtacatgaagaaacctcttattcatatttaagaggtttttgtcagttgatttatagttttattaaattattgattcgcaattctttgcctgattatcctgtaaactacatcatttatttttcagttctgttgatatgtgcgataaaccacatattcgtagtcaataatagagaatcacttatatacaataagattacaattataaaaaagccgttctttcatgcaaaactggcagtaatacaaagtttcaccatattataatgaaagcattgttccatacatacatgaaaatttttaagctgcctatatgacacaccacttgtgaaggttctatcatgactatgataaagcctcacttcaaatggcagttccttatatatcctttctcaataagtctatctatgatatggaagccctgaaagtattatattgacaggttcagatataaatgttaatcactttacatataggactatttattagacatcatattgcctttatttaacattttttatatttcgaaaattcatatttgaattcttctcagaacctgtgagtcggagtatggatttaaccttaacaagtcatggttgaatgatcaagctctttcttacgaatatcttgtatactcattataattactcttttcttctgttagatttttcagccatgtctttttacgataaaaccatgtagcgataattattttaaaaatactacagccctcgacaacagaaaacaaaaatagtataggcagcggaaacagccgcgcaaagattgttgaaagaagcaatggcccaaaacaggtaaataaaccgtcaatgtataatacagaacgtgtatcaccaccagcccttaaaatatagtaaattgtttctgaatagccttgtgtccatgtgatacaggacttaatgattaacaaccatatagccatctgcaagctttctccttttaaagaaaaaagtctaggagttatcggactggtaagtaaaatcagaatacagccaatcacatagatcatcaaacctatttttatcatttgtttcgcatccctcattgcctgatccagtttatcagcacccaaatcatttccaataatcacgccggttactgtactacagccactaaatacaacatagatcatacttgatatattatcaacaacagttaaagcaggtatgtattgctcactcacaaaacaataatttataaaaataagtgagagacccaatgaccatataaattcattgcaaaccagtggaatcgtctttttcagtattactaatttatgccttacatcaaaaccaccatatcgctgaaagaaataaaactcactttttttatgcatagatacaagagttagagagaccgcttctgttagccttgcaagaagcgtggcccacgccgcaccggctattcccatagctggcagaccgagcctgccgaaaatcagtccatagtttaaaactacgtttaagacaaaggaaagtgtccctgcatacatcggtatacgggtatgggcaattacacgatagccgacacccagcatttgcgcaacagcataaggtataaaggaaaataaaacaatcctgttatatgtgtttcctaatgaaatcaaattttgatttttaacaaaaactgacatcactgcagatggtgatatcagaagaatgaacataaagccacatgcagtatatatacaaagccttaatccaaaacgcaaggtacgattctcattttctttctgtacagctccatgatattgtgaaataaacaaacctaatccatttgtaagaccaaagataaccaaattataaataaagaaatatttatttgccacacttacagcactgatggcctgttcactaaaggctcccaacataatggtatcactcattgccagtaaatgggctaataattgctgcaatatcaccggtaatgctaagcttataaaatatctcataaatctgatatgcttcatataaaacctcctgatacatattgacattacattaagaaaaagaaagaagctgctcataaaactgaataatcagattacaagtgcttctattttcttatattattcgattacattttgtgtttcgcctttgacaatcgctatccctgcactggcacctaaaacgctagctccagccttgatgaacgccatcgcttcctgataattgtgaataccaccagctgccttaattttaatatcatcatgcagtatgcttttcatcagttttacatcttccagttttgcacccgcatagctctttcctgttgatgtctttaagaatgccggctttgctttatttgcaattctgcagatttctctcttcgcagcttcatcattatccagtttacacatttcaacaatggccttatcaagtattccatgtgttctacagaaatctgctatgcaggacatttctttctctatatataaataatccttttgttcaacagctttttggtttaatacataatcaatctctcgaaatcccttttccgcatatgtcttaaacattttcatcttttcatcaagtgacaactttccttccggaaaatcaattgcccccgctattataacacttgtatctttcaaatattcaacagcgactgcatatgtttccaaatctgcaaaaacacaacggaaatcataaaattttcccttatttatatattgcagaaaggtatcttccgggtcatcgatatagtcgatatatttacttatacgcatatattcctcctgacattttaatacagtaatgaattcatcaccttaattgattagtaaattatcccaggaaacctaagtaaacaccaacaatacccagaatcatagttccaaatatcaaccacataggatttacttttttctttaacagccagtaataaatccatgttgcgcttaatccaagtacaccaggcataattccatctaaaatcccctgtaccgtctgtacctcttctcccgatacacttgcaccaatttcaagcggaatagtcgcatagaacatatccttactcattgccccaataaccataataccgacaatgccggatgcaaacataaccttttccatcaacccactcttctcagcattcgcaaggaaagaaaagcctaattcataacctttcactgcaccgataaagcgtaccagaaaagctgggatattataaatcaggaaataagcgattggtcccataatatttccggatgctgatagggaaatacctacggcaacagcaattacacgtatacatcccagaaaaatggaatcgccgataccacttaatggtcccatgagggcagcttttacagaatctaccgcagctccttccaattccccttttgctacacgctcctccattgaaattgcaatacctccaacgaatggagcaagctgaggtgtaatattaaagaatgccacatgccgtgtaagagcctctgcatagccttcaggatcatctttatacacctttttcagcatcggattgatcattaagcagaaagccaaatgcatctgccgtggataatttccattcccaatgcaccgatattgcaagcagaatgtaacaaatccttttttgtaatcagtctgtcttctttattagaagtcgtcatcatcgtctacctcctcagcatttcctgcaagctgtggttttccttccagaaatccaaatttttctacggctataattactgctataattgccacacccagcactgggatattcgcataggatgccagtacaaagccaaggaagaaaaacggtatcagttttttattgataatcattcgcatcagcattgcaaaacccattgctggcaggattccagcggcaactcccatcccatccagaataaactgcggtatgaaatccaatagatcctgtactttgtctgctccgatataaaatgcgccaaaggcaagcaggaatttatatgaagtagcaaatgctcccatcaaccactgcgtaaacataattttagaatcatttccctgtgcagcaccatcatctgcaattttcagacagacaggggtaatagcagacaccagatttccgattcctaatgatataactgcaatcggcatggccaatgcaacagctgcatcaaccccctttcccatagatatagcaaatgcagtagcaagaacccctccgatatttacatccggtggtatatatgcacctacagaaattgctcccataaacaataattccaggctagcaccaatttctactcctgtttttacatctcccaaagcaagaccaacaagtggacctaacacaataggtctgaatgtatacagggtaccaaatgcataatccaaagaaccccaagctgcgataagaccgactaagatagcttgtactatcataaaatttcctcctaattatattagagcatgtgcgacattgatttttgaatcatcaaccaatgcacggatctcacactctacgcctcgattcattaactctttcaaaatagctttctcttcatcttccagaaatacctgcttactaatttgtgttgttgttttactttctttcgtatttccaagatttatactcgttatgcaaggacacccatccgcaagctgtttggcttctttgattgtctgtacaacaataatcagtttgtatttatcggtaactccgctgttaatcgctgctattgaatcagccatattcttaataaccagctttaccccgcttggctttcccagctttagtgtcgttttccagacatcatcattcacgacggtatcacttgcgactaaaatacagtttgcacctacaccatttgtccaggaaaaagcaacctgaccatgcaacaatctatgatctactcttactaatttaatcattctacatcacctttctagaaatcgtcttctacatcttgtgtttcaatcatcgaattacaatacttaacgtgtgtatcctcactattaacaatatcaagaatcatacgctccgtattttcttctgctgataaaaacagctgcatcaataaaggaagattcattccggtaatcagatatagatttttgcgtgttttcagctgtttcataaattccgtgttgacgctgcctccaaagacatcagtacatacaatgatttcatctgaatatggaattttttccaaagttccatttactaatgcttctatatcatttttaccatctatgaaggctgtgatgatatcgacacctgcctgttccccaatgatgattttaatgctttcatatatccctttcgaaaaacctccgtgtgatgcgattacataatgtctcatacgtataactccttcatgtacttttgatattgctgaatggattgttcatctgctacagacgggttttcaaaatattgtgaatttacacattctacagaaagaacaccatgatattcattctgaatgaaaacctgtaaatcctctttcatattccgttcaccgtcaccccaggcaagatgtgttgtatccgctttaacatctacaaaatgagcgtgaataatatcatcgtgaaatacatcaaaatattgttgaatggtgttcccagccattgccatagcaccggtatcaagacaaactttcaaagcatcacgctgtacctcctttagcagatgctgtaattcctcaacactgtttaccagaacagattcgttacgctgcaaagcttcaaccgccaataacatccctttctgttccgcatattcacttatttttttcagcatcttcacactgcgctgataggcgtcttcccttggctcattgaggaaagcccaaccgcttgttactacaacctgattcgcttttatttctaccgcagcatcaatagcattcttgaaataatgttcaacctgcaattgcatatctgaatctctgaccgccatattattgggttttggattcgtctgttcagggcagataccaataatttttatcccatattgatgttcaagatctttcagcttggctattgtttcataaccatgatagtccatgtagaaatgttgtggtcccgtccataattcaacacaggagtaaccatttgctttcgcattggcaaaaaatgattccagtgtataaaagcggtgatggcaattcattgcactaagctttatttccctattcatgcagcttcaccttcttgcattatcaaatgataggcctcaagcaaatcataaaccagataatcagccagcgattgatcaaatccaaatcttacatcgtgtttcgcaataacacgaataccggctgctttagccgccagtattccataagtggaatcctctatgacgatacaacgttcttttgctacattcagtttttgtagggtatataagtaaatggaaggatcaggcttgctataaggaaaatcatgcccgctgatgatttcattgaagtatccttttaatccgcactcatttaccattgtgacaatcgcctgtttaggtgaggaggatgcaatcgcaagtttcataccccttgcctttaaacgtttaagaacatataaaacatacggattcaagatttccgaataaacgatttcctcatcgctgtttgcttcatagaatttttcaaattccgaaggcgtaatatcctctttccaccacgctgacatcatttctaatccagcttcatgactactccctgccagcttcacaacttccttataaggtacatggatatcaaatcgacgatagaattcaagtacatgatgcatatagatgggttctgaatcaatcagaacaccatccatatcgaatataactgcatccattgattagtattcaaactggcgatagtatcggcggtaggcaagattatgcttagtatatgtttcataatagcttgcaagtctttctgtaaccagcgcagtcagaatcattggtgaaacgataaagcggaactccggatcaagtccatcgattgcatattctgctgtatcaactacaaccagattatctgtgaagcgttttgcgaatgcctctacacggttatccagctttctacattcatcttctcctttgaacaggaatacaggtacatctttttccaccagctctaatgttccatggaagaaatcaggcgaggacacggctcttgtacgtacccactgcatttcctcaagaatacacatggagaataaaacagtctctccccacaatgctccggaaccaacaaagatactgtaaggagctaatgcatactgttttgcaatctcatctgctctttcatcgaatttttcacgaataccaacaagatcgtggaaaatattttttgtttgagccacaaaatcatcatattttgggaattctccacggcgattgagtaaacgcaatgccaagacatcaaacatcaggtaactatattcacactgtccagttgtcacaggagcagtaacgatcattgtcgcaagctttccaagtggtgtttccggttttgtgaatgccattacatcgattccctctttaacaatccactctaccgcttcgacaatttctttcgtatcgccggatgcgcttgctgttatgacaattgactttttattcaatcttttatttccaagtacattcagctctgcagcatttgatagatgcacttctacttcagaatatttattcataatatactgaataggctctaattcatcataggtcccccccatgccaagcaggaatatgttttcataacctttatcatgaatcttatctgcggcagcctctacatcctttagcttatcgataactgcatctccatcttttaaataagtctccacattaaacttaggcaatactactttttctttttccatgttctttttctccttcgataactttcatatgcttccctttactgaaaactgctctattgcatcataggttaccattatcagatataaggaatatacaaagcagaatcacagatttctcttctacagtgtgcaccctgtggttcatcatataatccactttatatatttactataccatttgtattaattctttgcaagcgttttctttaatattttcaaaaacataattcttcataaaaatatatttacaactaaaaagcatacaaaaaaacgctaaaaagcctttaaatatcgtactttttgcttatattttaagcatattatatactagaaattacataatacgaggttcatatattataccaattatatagatttatataccagatttatttgactttacaatgtgtgtaggaataataatatgactattcataatttcacaatagaatttttaacttgatatatcataaatctttgataaaaaaatagaaaaaaaaagatacatcgtttctgatctatcttttagctcgaaatgtaaattttgctttatcgcagcgaacatagctttccgtgtattcaacaacattacctttagcatcttttccgatatattcaaagtaatatagaggctgtccttcctgaattttcatcagtctagcttctggttgtactgcttttaatattgtcaagcgctgtgaaaatactacaggtagatgtcctttgcttttcatataatcataaagggatacatgttcaaaattataagaatcaatatcctcgaacaaacggaacggtacataacaatactctaatgcaaaggattctgttcccatacttcgaagacgatgcaatacataaacatcatcattttttaaaatatgaagtttatttgccaaatatcctctgcattgaattacacccttttcaagtgtttgatttgtcaacggctttccactatcctttaaaacagcacccagtccccggccggtatcggtataattttcgtaaaatgcaaccttttcagtctctttttttgccacaaatgtccctttaccgtgaacacgatatagaatattggcttctacaagagaactaatcgcatttttaacagtcattcgattcacaccataggtatctgccatctctctttcactggggattttttcaccaggaagatattcaccatcctcaatacgttttatgattatttcttttaactgcatataaagcggcattcgataatccataaaaatcctcctaattcacgtaaacgaagcgttccatcttcataatactttctgaatattcaatttggcgattatcattatcatatgccaaaccctgctgcaacaccatctgtgttcctaattccacatgcaaagcattggctatatagttatctgcctcacaaatcaatatttcctgctcactgcgatttattgaaatatcgtattcactttccagtatttgatataatgcacggctttcaaaatctttcttttccagaccctgcgcatatttgatcggcaaatagctagtatctactgaaacaggttcatcgtcaataatacgtaatcgttgtaagcaatatacttttgttcctaaaggaagacgcagctttgtagataattgtttatttgtttcttttttttctatattcaaaattttgattttcatattcaagccttgctcaaatatagcctcacttgtcgattccaaatgaaaaacattctttactattctgggcttattaacatagtaaccactccgctgttttgagataataatcccttcctgcataaggatacgtaatccactacgcaaagtcagtcgctgaacatttaatttctcacacagctcccgctcactaggcagcttgtcgccttcctttaaattttcctgctcaatcatatttttgagttcattggcaatcatgatactcaatgttaagattttcataaagttcccttcctcatagcataaataaacctctttctttgttcattataccaaaagaaagccgaaatagatagcataattcttattgagatcactgttaaaaatatatttgcataaatatttctattggcataaataatgaggttgcaattatcatgatctgacaacaagacgctattaccgccagtttgcatattgatctgattctctgcttaacccctatcaaaaggcagaatctctgctgcttactggcatattatccaataaaaggaagcaacgcaatccccatactcacatacggggtgcctgcttccttatttatatacagtttactccagaaatttccttaaccgcttttttcctgaatcctttttcttacaccatgtttttgcctgttcttcctgtataaagctttttaaaggaatcaaatcactttgtgatcaaaggcctccagtgcacggtaatacgccggtttatcctcattgtaaatgataacaggggcgatatcatgaatcatgaaataataattcatcaatgtcctgcctgctctgccatccgcaaagggattatatgttcaaatattgcatgtagatatactcctgctgtaaagtaatctgttccctgatatgtattaagctctgataacagctctttcacatcggattcgacttcatgaggatacctgccgatttcatttttaccggttacataatcatgtattttgaattcacccgaacgttcctgtttatcatggtaacgaatatcatcatatgtacctttcataagcttatactgcatgcgcttgataaagtttatatccagagcttttttctctacgataagcagtttcaagtaattatagcaatgcacctgattttctatttcaaacagtgttctcagatcaccggtataaccgttcacatagcccttttcgaaaatatctcttgtgtcatgaaaatcaattctttcattttctattttattagaatgatacgcgaacagaatttaaaatcatagagtctcacatcaatttcttccagtgagttaaatgacatagctttaccattatgtatacctccgcatttcctgttcattataccacatatccatatatgcatgtacagaattattataccgcttattgtatttgcgaacagccaaataaatagaaaaggaccagatgttctgatccctatttcttagttatatacatttttgcgttccatgtgtattcaacgttccatcatgctgattgactcgatccccacacttccacctctaactacctcgatgtctctgaattcctctttcatcagcttaatgaccgcatcattctttgttgcggtttgcacaaattccagaaggagactgtctcttccataatcaatcacctttgccttaaaggtctgtgcgatttgaaacagctccgttttttcctgcagggtacagttctgtaccttcacatataaaatttccttcatacggacaaagatatccgtaaaatctatgaccttaattacttccactagtcgattcagctgtttcttgatctgttcaaaggtttcatcatcactgactgtcgcaatcgtcattctggatatggtaggatcctccgtcgttcctacggtaaggctgtcaagattatatgatttcccggaaaataatccggaaatcttagacaaaacacctacctgattttccacatacagcgatatccaacgttttttcataccgttaccattcatatatccattctctccttcctgtttcagcatcagtttaacaatccataagcatatcctttaaggtgccgttgggctgtatcatcggatacacaagatcttccggatttatgataaattcaatgattaccggtgttttcttactgctcatcgcctcgcgaagtgccggctcaatctgttccttttccgttacccggatcccctttgccccatagctttccgccagctttacgaaatcaggagtatacgttggacaggatacttccccgcatttattgcggcaggcagctccggcacgaaggcaggtcatggcatagcgctttccatagaacagcttctgccactgccgaaccatgcccagattgttattattgaaaatacaatttataataggaagctcctccagtacagctgttgcgatttcctggatgttcatctgcatcccgccatctcccgaaatggatagtacaggagtgtccggatttccaatttttgcgccgattgcccccggaagaccatagcccatcgtaccaagacctccggacatcaacagcttcttcttgttagtcagctcgataaactgtgctgtaaacatctgatgctgtccgacatcggtgacaacgatcagctcctcaaatacccggttgatggtttcgatgatgtcctgcggagtcagatacggcttctttttcatcatgagtggatgctcgcttttccatgcatcgatttcatccagccacttttttgtattatattcatgcacatattccagcattttattgattgcttctctggcatccgcaacaatcgggatgtctacctgtatatttttagagatcgcggcagtatcaatatcaatatgcactattttggcattgggcgcaaaggaatgcagctttcctgtgatccggtcattgaatctcgtgccgatggaaaacagcagatcgcactcatttacggccatattacaggcataggcaccatgcattccgatattccccacatacagcgggtgattgcttggaattgcccccttccccataattgttgttatgacaggtatattcgttttattaaccagctttgtaaagtcctcatttgcatgggcaatattcacaccgcccccggcaagaaacaatggacgttttgcctttcccagcattttgatagcacgcttcagctgaccgatatgcactgcagtattgggcttatatccccgaatattcaccttatccggataatctgcttctcccagctctcccataacatcctttggaagatcgatcagcaccggaccgggtcttccgcttgccgctatataaaaggcttctttgataatacgtcccaggtcttcccttctgcgaaccgtgacaccgtatttagtgatactgcgggtgattcccacaatatccacctcctgaaacgcatcatttccgattaaattccgggcaacctgtccggtaaagcatactagtggaacactgtcataataggcagtcgcaagaccggtcacaagatttgtcgcacccgggccgctggtaacgagacatacccctgttttccctgtagaacgtgcataggcatccgcttcatgaacaagagcgatttcctgccgtggaagaatgatttttatactgttctgcttatataattcatcactgatgtcaatggtacaggcgcccggataagcaaacagcgtatccacaccctcttcctgaagtgcctttaccaataacttattgccactgattttcttcatatgcatacctccctaatctatcttattactactttaacacaatacaggcactatgaaaacactttaaacctgcttgtttaagacatttttgtgacaaaaaccgtaggattcagcaaattcaaaaaaagactatgaaaaatgctatttcacaggcaatttatgtgcaaagaagctgatgtacaaaaaagcagataccatataaagtattgaatactgcatatactatctgcttacattataaaaacattttgttgctcacactaattcagacatctctatattctattgtatcaatacgttagtatttcaataccatgttctgtgaccaggagggtatgctcccactgggcacttaatgaaccatcctctgtataggatgtccatccgttatcttcatcaatatataaatgataatctcctacattgatcatgggctcaatcgtaaataccataccgggagccagcaccataccactacctgcacgaccgacatgaccgattaccggatcctcatgaaactccttgccaacaccgtgtccggcaaaatccacaacaacactgtatcccctgcttgtcgcatatttatgaatggcggcaccgatatcaccgacatgtccccatggcttgacggcatccatgccaatgttcagacattcctttgtgacctcaaccagatttcttgcctcttcactgacctccccgatcataaacatacgggaagcatcggaatagtagccatgaaagattgttgatacatcgacatttacaatatcgccttcctgcaggataatactgtcatccggaataccgtgacagacctcatcattcacagatgtacagcagcttttcggaaatccttcataattcaatggtgcaggaatcgcaccatgggaaacagtataatcatataccagacgatcaatttcaccggtactcataccgggacgaatatgctttgcgacatgatccagtactcctgtattgatattcccacttttcttaataccgatgatatcttccttgtttttaatcagagagcgatccggtacaatatgtccttccctggccagctttgcgagcttttcatcaaatttttcatggcactgcttatatttctttccactgccgcaccagcagcgtgtatttctatgcatttccatatagacacctcttttcaacctctatagtatagcacttatttctgtacttttcacatgaaaacatgcgaaagaaagggaaataaagtccttctatatcatctatgccttatagcattatgcattttgtataaccatgtacgcaaaacattatttccttacgatacggtttcggtatcgtggtataataaggataaagttaaggagctgatcatatgaaacgtctgccgattggaatagaagatttcaaggaactgattgacaaagactgttattatgtagacaaaacatcattcattacagacattataaatgaaaaggtcgcattatataccagaccgcgccgttttggtaaaacactgaatatgagtatgctatattattttttctcaatgaagcagaaggataatgcttatctttttaacgatatggatattgtcaatcatacagactcattacaataccaaaatcagtatccggtcatttttattactctgaaagatatgaaaaaacacacgtttgaaaatcaaaaggcgatgttcgctatcctaatccaggatattgtcagaaaaaatcaggagttactcgaaagtgaggaattaaataccttcgataaagaacagcttatagcatattatcgtcgtacacaaagtgatgtagatctgcagaatgcattaaagtttctttgcggttgcttgaagcagcattatcataaagatgttattcttttgattgacgaatacgatgttccgttacaaagcgcatatttaaaaggatattatgatgaaacggcagactttttaagcggtatgttcagtgctgccctaaaaacaaatgatgcattggaaaaagggattctgacaggctgcctgagaattgcgaaagagtcgatcttcactggcttaaataattttagtgtatattccatttctgaagatcaatccagtacatcctttggatttacaccaaaagaaacgataacactccttgaacactacgatttgaaatcctatgaacaaaccataaaagaatggtatgatgggtatctattcggaaacaaagagatatacaatccatggagcgtactgaaatatgttcaaaaaatcaagcagggaaacgatacaccggaatccttctgggcaaatacgagtggaaataatattatctatcagtacattcaaaaagcaaattcacatatgagagaggattttgatttattgacatccggtaagatgattgaaaaagccataaaacatgagctcacctaccgtgaaatggataaaatacagaacatttacagctttcttctattcacggggtatttgaaagtcataaaatgcatagatgaagaaaagagtatataccagctgatgattcctaacaaagtaatcaacagaatttataccctcatatttgaagaatggtttcaggaacaaacggaggcacatgctgagaatttcgctgaagccttgttgaaggaagatatagaaaccgcaaataaaatagtaaatgaccttctttttacttccatcagctattttgattatgatgagaaattctatcatggcatttaaataggcttgttatgcaattatcgcatcatgtctaatcaggagtccggtttgggaagattcgatatagcggttgcgcctcgttccttaagtgatcgggggatgatattagaactaaaaacagctacttcccttgcggaattaaaaaacacggcaaagcacgcatgtaagcagataaaggataaacaatatatagaaggtatgctggcggagggttatgaggatattatcggctatggcatcgctttttataagaaattctgtgttattgaggctttaaaggatagcacggatactattgtaaacgatacgagcattcaatagttcattattccaaaaggattgcggacccgcaatcctttttttatatctaataatttcgagatgcctcttttcctgcatccttcagcttttcatgctcctcctgctccagttcttttctggcaagacgcttaaaatccgcatctcttgtttttcttctaggaaggaattgtctagtaaaagcaccctttccacgctttttcacataaaaatagccaaggatagaaaatgtagaggcgcctataaaattcacaagcaaatcctccatagtatcaatcagtccgatatccagataaccgttaaatcccagctctttgccatttaccgcaacggaatggatcccgtcaatcgtaattggtatattgctgttggttggatccagcataaccgttgttatactttgcacgatcgtatccttctgcatatccgttcccatgaaggtatccataccaaattcaaagaattcccatacaacaccgattgtcatggaaaaacagaaagcaaccagtgccataaacacaggggaaagacgaaactgcagacgatcatcattattcaaaagatccacaagtgaaaaaccgattgccgccgcaagaaagccgttcagcgtatgcaggatggtatcccacatgggaatcagaatatagaaggactggatttctccgagaatttctgcggaaaagataaatagcaggatgataatttccaatgctgtcggcagttcgattttcagctctacctgtaaaaagcttggtacaatcagtaaaatcagtgttaacaggcataaaaatacattttcaaaattcctgttgaatatctgaagaatcataacaagaattacaagtgcgcgcagggttaggtatacaagaaacgatttcctatgctccttgatctccatcttgattgcttttttcattgtctggtattttttcgacataaaacacctcctgaattttattacaatcatatagaattctgaaggaaatttcaataattctttttaatatatttaaaaaaacaaaaaaataaattaaaatcacatttattaaagggttataaaatattgttttcataatttaaatttaaatagaaacagttatactatgtaataattatgatttttaaaccaaatcagaacctatattttactccgaagtttactaagttataacttactaagttgtaacttagtaaactaatatgcctcataaattatcaatataaaaagtctccatattcttccgcatgatagacagattatagaaattcatccttgtgtgaatgttatgttaactgtataattcgcttccatatcacgtaagcatattttatgtgatcaatcatagatctcagataatcataaaatatcctgtcacaatcaccataacaggatatcttatttctctattagattatttgttactttgcttcatttaggtcctgtttcaatcccgaagaaacacattgctctgccttccatgctttatctgcacatcccagaattttaatgaaatgctttgctgtttccttatatccttcctgcagcatcggcattaaggcatagatattattcccctccataccgacttcctgtattttattatacgctccgcggaataaatcattggctacattcaccttactgatacccagacggcatgcagttgccagattctcatcaccggtaccgctgccaccatgcagcaccaatggcaccggaactttctctgccagctcttttaaaagatcaagacgaagctttggctctcctttataaacaccatgtgcggaaccgatggccacagccagacagtcaacgcctgtctccttcacataacggactgcttcatccggctgcgttagggctgcaataccatcaacagcataattctcaccgacaccgacatgacctagctctgcctctacaccgacacccgcagcatgtgcaattttcacaagctccttcacctgtgcgacattttcctcatatggaagggaggagcgatcgaccatgatggtatgaaagccggcatgaattccttttaccgcatcctcaaaggttgcactgtgatccaatataaacgctaccggtacgctcgctttgatcgcaaaatcatgcagcatgcggccaaaatactgcatatctttattatgaccccagccacaaagcataatcaggggggcattcatctcctcagccgcttccacgcatgctctcaatgaaagctcatctacagctgacaatgccggtactccgtaatgtccctcttttgcccgttgcaggatttctgccatacttactaacatcttatattcctccttaagttaaaatgtgataataatacgaaatgtatccggacgtattgctgcttcaaacgcttcctgtgcctgattgcacggatatactccggaaaccaatttttctggatcaatcaaccctttgcttaacatattgaccgcccgctgaaaggaacgtacgcttggacttactgctcctgtaataaccgtttcactggaatgcagccagtttggactgatttcaatcggcttatcaggatgctgtgagctgtacatgacgcatcttcccaagggtgctgtcatctccacagcctgcttagcaacagcactgatcggtgttgtgttaaagacagcctctgcaccgataccattcagattttttatgtaatcaaccggatttgtttccatcgggttgatagtatcatcacatcccagtgtctttgccagagcacgacgtttagcatccggctcactcatgataacgcgtgcacccgacagcttggcacagagtacatgtagcattcccatgatgcctccacctaacaccgctacatcatctcccagtgcaatctgtccacgttcaatcgagttcagcacacatgccagcggttcgctgaacaccgctgctgtatcagagagtgattccggcagcaggtaagcctgagagggatcgatattcagatattctccaagccctcctgtacctggtatttccatttccttatcaaacggcgcattgatatctacgcacagattctcttcaccatgacgacagaaataacattttccgcaaacctgaatcaaacgagctgtcagcttccttccaatcggaaactcacgttcacttaccccctccccaacggccgcaacgcttccgacaatttcatgtccgccaacaaacggcagcggcattttggactcccgtgtaaacacacgctgttcccaggtacataatgcacatgctttgatatgcatcagtattttgcccggctttacatcaggacgccgaacctctttcacctcaaccttatggtcatttgtaatcgctactaccttcattttcttattcatatgctgtcctccattcttttccatcatataattcctgatacattgcttttaattcagctgcagagaaggtctttggtgcacactgcacattggcatcctgcatcgcctgcttcacataggtatcaattttacacatataagccttacgatcaatacctgcttcctgtagggtaaccggcatctctatttttcgatacatctcccatatccttgctatcagacgctcctgcttttccatagaggtcccgcagattcccagctgatcagccacttcctcatataaaggctgcggcagcagatgacacatcgtatacggcaggataagccccgtcataagtccatgcggctttctgaaatcaccaccggcctgatccattccgtgcgccataccggttatggagttattgatacatgcacctgcaatcgttgcactcaaatggatatcacgacgtgcattcaaatcaccattgcaggaagcctccagctgttttataatctgcacagcggcctgcacactttgcatccgtaccatatccgaagccagaacagaaatacccgcctccaacgcatgggcaagagcatcacatccggagaatgcaacgacgtgcttaggaagacttaccaacagctcataatcaagaatggctgtgcttggcatgatttcattgcttaaaaccatacactttcttttctctgtatccttaactaccgcacagcccgttgtttcagagcctgtcccactggttgtaggaatggcaatcagttcctttttctttgtgaatgattctacagcatatggtgcaaatgcctgttcccaagtgtaatcagggaattctgtaaacagccatagtaccttcgcactatccaggacggagccgcctccgattgccacaaatacatccggatcaaagcgctgcgcttttcgaatggccggttccagaagctctgtggtaggctcctgcggcatattacagaggacttcataatcgcagtcctttaaaagctcatcaaacagctttgtttcaagctgtaatgccttcaaaacattttcatcgacaaccaagccgatttttttatccttccaccgttgtacttcacgaagtgcaccatttcccatgatatacttcgttgtttggtattgtttaatctgcatctattgcctccctatacactcaaaattcccgttaatccgccgataacaccaatagcgattatgaccagcataaccaaaacacttgattttcctgctttcagcagcttgtagcagcccagtgtcaataacagcggaagcatacttggaagaatggcgtcaaatagctgctcctgcatggagaagcttccttctgcctgtgggatgctgatgccgcatttcattgtcacaaaattaacaaccaatgctcccagtaccatacagcccataatactcgcagcggatattaaacgtttgataacaccattctccagcatactgagaattgcatctgaacctttacgataacccagtaaaaatccaaagcgtgatatgccgaatacaataatcgccataaccaatgagaatacaagaggaatgacccagttaccaccttttgcaaaatctacagcgaatgcaataagcagggggaggatgacaccctgtatcaaggtatcaccaatacccgaaagcggccccatcagtccggttttaattgaggtgattgcatcattatcaagttcagctcccaatgccttctgttcttccatcgccagaaccagtccaacaatagatgaccccagacaaggctcacaattaaagaagctggtatgacgctgcatggcttctatacgtaaatccttattatccttgtaaagctttcgaaaggccggggtcatggcatgaaggaagccgattcccatcatacgctcataattgtaacaggcctgattattgaacagccatagcagccaggctctattaacctctttgctggtaagcagatttttcttatctacagtttcactcatgccgcattacctcctgtactctcttttttctgtgtatagacgattgcaatacaaagcgatataaatccaatcgcaatcatactcaatcccgaatatacagaaatcaggaacccgatgaagaaaaagatttttgcctctcctttgaaaatatacatcagcgtcaagctaataccgagagcaggcatcatccctccgataatcatgaggatatttaatactgtcccgccaagagcatcaataataccctgaatatagctggccccgaaatagcatgccagcatacatggaacaaaggtaagcacaaacagcatcagctgcggcaacaatacagaaggaatccaaaccttcccagcctcgcctttttctgccagatgatctgccatatgtgcaaatactgaatccagtgtcagacgtccaaaccaaagtaaggtaccaatcaatccgattgggacagcaatcgccagagctgcttccgtatccagaccacctgtaattcccaaagcggctcccaggataccagccagacacatatctccgggcaaagcaccacctgctgatataaaccctacatacatcagatttatggtagctcctatcatagttccctgtgcgggatcaccaagaaacatccctgtcagacaaccgcttaccaacggcctgtaaacagaataataaccaaccggtcctgcaatgatcgagctattccccaaataataaataatccccagtaaaacagcctgcaaaatactcataatacttctcctttcctatccgcttatcattttaccaacatcacttggcgactcattcggtaccaactgataatacatcggtatatgcttattcatgatgcgctgcatacactcgatttcttcttcacttgctgatacattgcgattaaatttcctgcggcctgactttgcccccattccccccagaatcactttatccagcagaataccttcatcaattaaagcctcaaccacctgtggagtctttaccaaaataataattcgttctttatcctcagcctcctttttcaactcacacactccgttttctatattgtatatatcaatacgaatatcggaaggtgccgctgccttaatgattttctgtaagaaaacatccttcaccaatgcttcatcaatgattacaatacgattaccctcagtctgctttacccatgccgtaacaacctgcccatgaataagacggtcatcgatgcggcataacacaatatgtttcatgtttagtcctccttcagcatttcattaacatgaatgagcgttttcattccctctgacattatgtgtgctatcatcatcttcagctccatctgcgttcttgaacagagaatctcaagtaaaatgggaagattgattcctgttaggtgttcaaatgtgtgatccttcatcaatgacgctgtaacattaaacggacttccagaacgcatatctgttagaatcagtatttcacttcccttccgcgtacagctgattgcctgcaaaatagagtccctcagatgttcgacgctttcacctaaatagaagccgaatgcctgtacgttttcctgttcccccatgatgagttcactgcttgccagcatcgcttttccatattcgccatgtgtaacgattatgatatcaatcatatacagcttcctccttttcctttctgatgtcatcttatcatcgtccctttcaggtggtcaaaaaagtccctgtttcaacacactcaggaaagcgtgtgaagaaaaaagaaacagatttaccagcttttattccgataacttccagtgcaagcatacacaatatgtatacattgtaaaaagcagacacacttttagacttttttatgcgtttttattcttactgtgttattatgaagaagaaatcaacacaaaaaaattaaggaggtcgtgatttcatgagtaaacgcaaagaactgattctgaaagcaatttatgcgcacaccttggaatgtctggaggataagcagtatgataagcttggaatggatgcctcctctttggcgatggatttgcggcttgatcgatcaaatgtatccagagatctcaacctcctgcatcaggaaggcagactgatcaagctcaatggcagaccaacactatatgtttcacgccagcttttgatgaagtatttccccgagcagaacatacccgccgttctttccaaggatcagcagcttaccgattttctgactaagcagcagcgtcagaatgaacaaacgcagatgaaagaatctctggatacattgattggaaaaaacatcggtgaaagtatgtatgagccgattcaaaaagctaaagcagcaatgaattacccatatagcggattaaataccattatcgaggggcaggagggaaccaaccggaagagttttgcacagctcatgtttctgtacggcaaacagaatggacgattttcttcctttcattctccgattattgcagactgcagccttttaaaaaattattctgttcatgatttggatttgtatgtattcggagaaatcatcgacagccgactgcgccgcggtctggtggaaaaagctaggcaggggatgctcatactgcttcatttcgaacagcttcccgatttaataaagataaagatatgcaatgcaataacagaagcgcagtaccatccactcaacgctgtcaatcgcagatttacatttcaatgccaggtgattatcacgacctcctcacctgaattaaaagaggaatccatgatccgccgctgttttccaacgctaatttccctgccttcactacagcagcgtacactggaagagaccgttatgctggttcttaagcagtttcaggaggaggcttatttcatcaagcgagccattcgcatatcaaagggaattttgagctgcttcgcaatgtcctcctataagggaaatctgccgcatttaaaagctgagatacgcagttcatgtgcaaatgcctatacccgtttgataaaagaaaatcccttatgtatcactttggatttcgccgatatatcaaacacggtactatccgatatttatgatgtaaacgagcgttatcagcagttgaatacgattttagctttatttacacataatgatttctacttttccacgatgaaagagaatgaagaattacagatgctctatcatatcaatgaggaattgaatcagaaaaaaaacatttctataaacaatgcaaagggtgaaattgtaaatcagtgtctgaatgatatgaatgcattcatgaatgttcacctgaataccatacgctctgttttattgaaggatatttatgatttattatatcctgttttacaggataaacctatttcgcgaaatgaaaacatactttatggaatgttaagtaagctttctgaatttatctcagctttcaaagaagacacggttccggcgattacagatgttggggcgatcagcattgcacgaaaaaaagattacctgttattcgacgaaattcaagaagctgtttcttcacgctttaattataccttcacaaaatgggagcgtgattatattgcgacctatgtttatctatccagtcaatggctgcaggaaacgcaggtacagcttctgattgttacagaaaatggccgctccaaggaatatgcacgttatctgcattcgcatgattacgggaaccagattctatctctggagttggatacacaggtatcccatgatgctctcttatccattctgacaaagcatgtacaggaaagtgataaggggaaaggcgttttgatcattacggatagtaaagatatcaagctgctggagaaggaactacagactttgtcaaattgtcatgtacgcatcgtcccagaccttgacctgccgctattgttaacactgttaaaacgtgcaagcagtatcggagcaacctttgaaaccattcttcaaaaggatgccgaaaatccgattgctgaaacagaagccaaggactctgacagctatgcaatgcaattgattcaacaaatggatgaaaccattttaagcgattcccttgtctttctaaatccgcgtaagtcttcccaaatactttataaaacattaaatgccatcataaagcagctgcagctgccttattcagacaatctgttgattaagtttatttttcactgctcctttacactggagcgctgtataaaaaatgagccactttcttttccgaagatgaaggcattcataaatcgcaataattatgtttacaatatcattgagcggaattttcatgaggttcaggaggttttcgattgtacgattcctccttctgagttttcatttatcacggagatatttctgcccttaacaaaagaataacgattattcctgagctgttgaacatacttttcaatttacccaaagtcctgatagtttaaaaatgaggttatctgttgaactgttatgattttaaaatatagcgcctctttcgttgaaatttgcaccgccatatcagtgacgatgataacctcgttgtctttctgcaaagcgattaccacttcattatgcataatattactgataaaaatatgttaatctgcatttttttatcgataaatatatgtgaaatatcatatttttatcattacgtgatatactattatatgaaggaggagtccacatgaaaagaaaaatagagcagcaacttttaaaatggaaacagatgccaaacaaaaaaccactattaatcaaaggtgctcgtcaagttggaaaaacatatagtatacgtgcatttggaaaagaaaactataaatatatggtagaaatcaactttgaaagagatatttcatatattgaattgttcaataaaacacacaatccaatagagctacttgattatctcaaaatatccttcatggatataccatttctcaaggatactctcttatttttggatgaaattcaagcatgtcccgatgctataactgcactaaaatttatgagcgaggtcttttcctgtgatatcatctgttctggaagtatgttgggtatcgctatcgctaagactacctcgtttccagttggttacgtagaaacatgggatatgtatcctatgagctttcttgaatttttggaagccgttagcataaataaagatattttgaatcgcataaatcaatctcttgaacggctggaagctgtacctgagatattacatgataaaatgaatgagctttttacaaaatatatgattatcggcggtatgccagaggtggtcgcaacgtatgctgaaacgaaatccataaaggaatgccttatgattcaaagaagaattgtcaatgattaccttaacgatatggccaaatatgccatatccggggataagataaaagctagagaatgctttcaatccatccctgttcaacttgcgaaagagaataaaaagtttcaatacagcgtggtaaaaaaaggatacaatgcccgctattacgattcaagtttacaatggctcgaggacagcggattgatattgaaagtaaaccgccttgctcatattgcagaacctctggtttctgaagtggaattatctgtatttaaagtatatatggcagattgcggactctttatctcacagtttgatgatggtgatatacaaaaaataatccgtggtgatttaagtatttacaaaggagctatctatgaaaatatagctgcacagatatgtaaaagagcgaataaagcgtgcttctactatgagccgagccaaagcacagaaattgatttcatcattaaatatgaaggagaaatcacccctttagaggttaaagctggcacacatacaacatcaagggcatttcagaacttcgtaaaaaaataccgtgtaaagaatgcctttcttttttcaaagaagaatacaggagtatctattgatggagttatcaaacacctgccactgtatatgctggaaatcatactggagcaggaaccggatattttttgacgggcttttaaaatagaattaaattgaaatggtatatgcaactaatatcatgttaaaaagacggattaaatcatctccgtctttctttgtaatcattaatcatgaaacagcgtatctgaatcgagatacgctgttttacattctaattagaataaaccttcgatatgccccttttcatcgatatccatgttatttgccgcaggcatctttggaagacccggcatcgtcagtatcttccccgttaatgcaaccaggaaaccggcaccaagactcgggcgcagctcacgaaccgtaatcgtaaaattcttcggagccccatataccttcgcatcatcagacagtgacatctgcgttttcgccatacagattggcatcttatcccagccaagggaagtatacaacgcaatttgttccttcgcctcttctgtaaatgccacttcttctgcgccatacaccctggtcgcaattgctgtaattttttcctcaatgctttgttccacatcatacagcggagcatagctgttttcctctgcacaaagctccaccagctgattggctagatcaagcgcgccttctccgccctttgcccatacctgagaaaggctcatcggatgctgatgctctttacaccagttctgcagtgcttccacctctgcaggagtatcgctcgcaaattcattgattgctacgatataaggcagtccgaactgctttactgtatcaatgtgctttgcaagattttcacaccctgtcagcatcgcctccacattttcatccttcaaatcctcatatactacattgccgtgctgcttcaaggcacgaatggttgctacaattaccactgcatttggcttcagcccaccgaagcgacacttgatatccaggaacttttcagctccaagatcagcaccaaagcctgcctctgtcaccgtataatccgcaagcttcagacatgttcttgtcgcaagaatggaattacagccatgagcgatattggcaaacggaccgccgtgaatcagtacaggattatgttccagtgtctgtaccatattcggtttgatggcatccttcataaccattgccagagccccttcaatgccaaggtcctttacataaatcggctccttctttgaattaaatgccaccagcatattgccgaggcgttcctttaaatccatcaaagaagtagacagacaaagaactgccatcacctcactggccaccgtgatattgaagccgtccacacgttccacaccattcgccttcggtccctgtccaatcgtaatgtgacgcagcgtacgatcattcatatccagacagcgtttccatgtgatgttttctatatcgatatccagctcatttccctgatgaatatgattatccagacatgcggaaatcaaattgtttgctgttgtgattgcgtgcatatccccggtaaaatgcaggttgatatcctccattggtacaacctgggcataaccgccgccggcagctccacctttcagaccgaaaaccggacccagacttggctcacgaagcgcgatcatcgtctttttccccatccggtttaacgcatcccccaaaccaacagtcgttgtggattttccttccccggcctttgtcggattgattgcggtcaccagaatcagcttaccgtcttccttgtcttcatttctgtgcagcaaatcgagagatacctttgccttatagttaccatagtattccaggtcctcttcacccacaccgatttttgccgcaatatcacgaatatgctccattttacattcctgcgcaatttctaaatctgttttaaacatagcttcctccttgtatatttctcttattcactatagacaaaacctaatgtattacatatctttctttccaatatcatttctgtaaaagagcttatcacagtgaattctatgtacatccgcatatgctttttcatatgcttcctccagtgtatccgctgcagcgcacacgcacagaacacgaccgccgtccgttaccagactgccttccttttctgccgtccccatgtgaaataccatggaattcacattctccaaattttcaatcacagcgccctttgtactggaagcaggatacccctcactggccataacaacaccaagcgtaaccctgtcgtcccattccagctctgtcttggaatggttcatgatattctcaatcacgtcacagaaatccgttttcagcctcggcaggataacctctgcctccgggtcaccgaagcgtgcattgaattcgattgttttaacaccatgctttgtcagcatcagcccgccgtacagaaatccggtaaacggatgcccttccttcaccattgccttcgccatcggtatcataactgcattcatcgtttcctcaataatatccggtgttatcttcttaacaggagagtagacacccataccaccggtatttggacctttatcaccgtcatacgccgccttgtgatcctgtgcaacctccatcggaagaaccagatcatcacatacaaagcaaatcaaggagaattcaaagccctccaggcattcctcgataacaacacggtttcccggaacactgaacgcgatttcgattgcatccaatgcttcctttaattcataagcaaccgtaacaccctttcctgccttcaagccgtcttcctttattacaatcggcacgccctgatgctccacatagccgattgcatccgctttattgtcaaaggtctggtagcttgctgtcgggataccatacttcgccatgattttcttcgcaaagtccttactggactccacctgtgccgcatcctttgtcggtccgaatatctttagtccctctgcctgaaacgcatcaacgattcccagtgacagcgttgcctccggtccgactatcgttaaatctatttcctgttcctttgcaaatgcggttaagccctttacatcactgtccgcaatattgacacactccgcaagctctgccattccgggatttcccggagctgcataaatcttctttacccggccgcttctgcttaccgcatgaaccagtgcatgctctcttccgcctttaccgattaccaatactttcatcaaacaatcgctccttccgaaacataaaaagcatgaaaagtcacagtaaaccttccatgcattgagccaaaaagtttacttgtagttcgccaatttacggtcggcgagtagagacgaatcatccaatcatgtttctatacaagtaatatttccactcttattttactttattttgtacaacattacaattccatttcaggaaagtttcgggaaagcactcaatctataatcacatgatagtctattccgaattctttatgaatcgccagcacctgttccccataataaatttcctttcttccatccttttcaaacgtatatttcagattggtataaatataatcatatgctgagaaatcctgatacggtattcgaatccgatagcttttctcatcctcgctaatttccgctgccttgactttcagatcccgattaacaggctccaccgttttcagacgaccatatgcgttctttcgtatacggatatttatcacttgttcctccgtgtttccgaaaaactcagactcctgcaatgcttttcccttcacatatcggatatcataccgtcccagatcagccgtcctttcttccccgttttctgtatactggagtgtttgaaaacggacacgacttccctgcttcataggcacatagacggttaacggggcagcttcacaaaaccatacagcaggatccatcggctgcttcatatcaaaatctatcagctgcggctctgtgacagtattacgcgaaggcttaccctcttcgagcataatactctccacctcatacaatgaggtcttgctatattctacactgttgtgtaaaaattcagccgttgaagctgcaggctggaaagcataccataaaagaagaaacaccaccactaacagaggcagaagcagaagtatttttttatttactttcattttgtatccctccattttctacagtaaagcgaatctcttcatgtatcggatttttattttcttcttccgttatgttccgcagctccagcttcaactcggaagcatcacaggattcctgcatagttcctcgaaccatgacatatagttttttatctttggggttcattatcatattcgttgcatatgtaccaccgaaaatatcctgcagctctatatagtaatactcctttaaatctgttgcggcacgttcatagctgatgatataaacgtagtcctttttattctttatcgcatactgcatccggatcccatgcttaagctcctgttcatgatatgaaactgattccctgcttttcaattcttccatgtgtttcagctcttctgtaatcgtttgttcatcggcatttaggtcaagatagctttccgtcgtgaaacagctcctttgtttcatgtcacctggctgtgtgttccatgcgaaaacaagtaagctgcaggctgcagccaatattgcgtaagcaaataatacggttttcggggaaggcagttttcttacagctttatcgagcagtgcagcattcagatttttatcatagtgatatcgatacgcaatataaagaagagctccgcctaggacgagcagaaccagaacccatggccattgcgtaagggaggctgtagctttctgtgcaatcgtatccattctgtttacagtcacacagcaaggcgctgaaagcctctgcccgcggtttgatttccattcctataaagctcaacaacacctcgtccataccgttgtatccttctgccgcttttttcaaaggtataacagaaatttgtagctgtcatatcatattcctttggcagctcatagcgaagtataactcttgtgtctgtatcaaaatcgccatatgtatttctctgtatttcaatttttataggagcatccggattcacagcttcaacgtggatcagtctccctgctaccttcgtatttacatcaatatacagctctttttcctcagaatcccagttctttgaaatggaggcttcttcaaaaacctctccgcttttttctatttcatatataccgatatccgccgttttctcctcctgatccttttgataggtgattttggaaaagcttaccttcatatctttaaacatgggaagctgaattccataagcatagaaatcctcatcctccataggtgcttcctcatcaatcacataacggggatcaaccacagcgtctgccttgtaatctgcgattctcgttatcctgacaccttcaccgccttcttttttaaaccgtactataagactttcctccatgtcctctcccggaaaatgaaatcgaatacttgatttcagaaatgtcgcttccttctgtacaggtgcacaccctcctatacagcagagaataagcagccctgcaattcctgttaattttttcatcgatggatacctcccttttcaatcgtgtagctgtcataataatcgacacgattcttatttttcccccgggtataattgtatatgtgaatgctgcgcttctgtgctgcgcaagaatccttgatcgttcctgtggtcatggatatgattttccgcgaatccgccttgatttccccacaggtccagccgctgtccgtacggttacggattattatctgttcatccttttgcggttctctcagcagatcatacgtaatgacatatacatattccttgcgatcatttactgcataggttacagttacatgcttattcggcttttccttctgcatgctgagggatttgctgcctttttttacagcctcgagctgttccttaaccatcgcttcatccactcctgcatactgcaccgtatcatacatatcacatgtcgtttcactttgctctgcttcacgcagataataatagcccatataccaggatagcgtcaggatcgagagaatcccccaaatgcataccactgtccggactgttaataaatgaatctgcttttccggtgtttttaaatgttgattgacccgcagctcatagtaatgcttataaaggacataaaccaccagacctgccagtaaaagaagtagaataagcagaagcaaaccggtggatgattgactgtcaaacaaagtctgtagcatatgcatccctccttaaaatcccatttcttccttgaaccggtaataatagcttctggatacctcgatttgatcctcgtttgtgagaataagcgtaaattttgaatttaagctgcttcggattcgccgtatatcctttttatttacaatgaacgccttatgaactatcagaaatcctttttcatacaaattggcctccagctgatacattgtttctttaacacggtacctgccgtccatggtatgtatccatatttcctgggaaatgctttctatatagatgatatcttcaacagcgagacgcatgtattcctcatgatccctgacaagcagatagcggtaatcataatttgcctcgtacaatacataatcggcatcctcacaaacagtaacctgccccttttgaagatcatccaacagctgttctttcatctcttttctgcataatagcttaagtttcatactttcacccttttcacctatagtttatcggaattcagaggaaacacaagcagtatgatataagatacaaatataggcagtaacatgcacaggaaaagcaaatatatgtaaagcacgcttcacatttttatcatccggtggtatactaaagatgtaaaggaggctttacattcatgaggaatcgaatacgaaagcttcggcaggaattacaaatgacgcaggaggagctggcacagcggtgcagagtcagccggcagacgatcatctcactggagaaggggaaatacgatccctccattcaccttgcacaccgcatagcaacaatttttcaacatcatatcgaggatgtatttctttttacggaaggagcggatgagtcatgaaagaacagaatattataaggatgaaatgcattacgattctactgtttatcatactgtcagttgtgctgattgttgtcggcttttcgcaggaatatcgcagttcctcccttttcagtggaggtgtcggcggcctcatcgtttccctgtatatgctgaaaacgatatggtcagccaaagcatcacaaaggaaacgtgagcaattgattattgatgaaacagatgaacgcaatctgctaattcagaaaaacagcagagcgcaggcattcaacgtatctcttatcgcaactctggcagcctctgttcttgcatccttatatcatgaagaagccatcaacagctgctttaacattctcctgggcattcagctgtttgcctatttactgatctggatgtattacaaaagaaggctgtagctttccatatcatagacctgccggatgaagccgattatagggatgcatgcgcaatcatcaaaagcttaccacgtacgatccggttcctgcagggctgctttaaaaatactgcctgtgcataagctcattggctgcttgtatacaggcagctttgccagacttcgcaatacattatattcaccaaagaagatggtattgtaatatcgtaaaggagatgctgtttatgcagcttgtatggattctgctcattgcggcagctattacagttatcgagattcttatctatcattaccgtttgccaaggttttttctgttcatttttccactcatcaatatttgtctggaaatatgcattgtcttttacattctgcgtcagcaggcactggttacgagctattatccgctatggatacgaatcggtatttatcttctgccgcttctgttatccctgtttatcatgaccggcttcctcgtacgcagatatgtaaagctggaatatacaaaaccgtttcgccatatcgtctgccgtctgtttgcatttcttctgatcagtatgcttttcatctttctcacaaccatttattttgcacaggaatatgttatcttttatccaaatgcaagtcctcaggatcgggatatgctcatggcggataaagcctatgagcgtatcagcatagattcgcaatataccggatggttgagaaaagcagagaatgcggatagcatcatagtgtattttggaggaaatgcacagaataccagtgccttatgcagagaatatgatgaaagcggaattttctcttatatgaagaattcacactttctcagtattgattatccttcctacggagacagcaagggttccctgtcacaggaagagctatttaagatggcggatgcagtcctgcattatgcccgtcacagatatccaaataaaaagctgtatatcgtcggctacagtatcggtacaggaatggcaagctatgcagcttccaaatcaacaccggatgcactcattcttctctctccatacaataacgggagagatttattcaattcctatttccctgttttctatggtcccctgcagcatctgattcgttacccgctaacaagtgacaggtatgtcggtgcactaacctgccctgctctggtcatattgagcaatcaggataccatcgtttctcccagcctctcaaggcgcctgattgaatgcttcacaacgccggttaagacgattccttttgatacattggatcatggtgatatcgctatgaataaagaggtatggaaatccataatgcgctttcttcatgagctttctgaatagattctcatcatgaatttgcttaaccgacagccatgaatatttctgtaccatgaatcgatatgaaaaaagctctgtatacctgaccttatacagagttttatctatgtactgcattccgcaaagagcctaggcagctgcatccgaatggcctgttttatataggaataccgttgaagataatcgattttcagcagcgtgctgagtatggatttatccttacagctgtaggcaggcggtatctgcgctcacatgacaccaggaacacatccagcatcaatatattcatatcaaccgtatagtatgctgtgagaacagctgattgcactgcttctgtgtatccacggcaaggctttcaatctgcgcatggataccgttgatgaccatactttatgaaacctcatcgacaggctcctgctttctgtatatcccgtataatctgctttaacgactccagcttctctgactgctcctgtacgttattcacaaagcttatatccgcatgcttcgataaagacattaacactcataagccataccgttttcttaaacaaaaaaacatggaaatcactccatgcctttatcctttttcatatattttctcttccagctcatcaaatttacgatacagatcaacgaattcatcacataaaattttgaaggattccgcactcatcagtaaatcctgcgcatgtgtgagtagaaggtttaaatccaccggatttcctccggcttcctcctgaacaagtcgctgatgtatacgatgcccctttgcatactgttcattgccctttcttacaagctcgttacactgtccgtagtttttacttttagcctcctgaatcgcttcgatataaagacttctagcctgtcccacggaagaaatgatttctagtatttcaagttctgaactgcccatcgtatccatctcctgaccttttctgttctactattgtatcatacccataccgtgatttcactaggaatttaaagaaaatgatatctcttacaaaagatgccgaattcattactgattgaagtattctctcaatcgctttaacagctacaggatatgcagacctatttctatcatactctcaggcattcacagccgcttacagacccaacagtaaaacataatactcaaatcagcagatctgctttctgaaggatgtaacaaaacagctttataaagggatgctcaggactatcctttccaaatatcttcctaaatagctagctgcgataagcagacttcatacagcgaagcttgatttcccgacgtatgatttcctctgccgttttcaacgcatccttttgggaatctatgattttataggcaagcatatcactcaatcccattacaaggctccacatagagaggatctccttctgatactcctccggcggacaaccgtgttttttcaaaaaggcaagagcggtactgcgaaatatctcatacgacttcactgacttcttttctaagtcctgcagctgaaacatttgagatttcatgatattggtatgatatttcaaaaaatcaggatgctgtaccataaaggctacatagcctgcaccaatctgaatgatagcctcatctacatcaccacccgcattctcataggacctttgcaatgcctccgtgaactgttcttcgatatatgcagaaatggcgctcataaactcttccttattttgaaaatgcttatacagggcggtatgtgaaacatgacagagtgccgcaagctttcgcatagaaaggcttcgttccccgtacacattgatgtaacgaatgccctcctttatcaatgtattttttaaatccttatgatgatagctttgttcacacatgcagaccagtcccttcttacgatataactgtattttatcacacgatgttgacagtgtaaacataatatgataccctatcaatgtaaacagcgtttacttagctgaagaaaggatccatcatgaaaaccatactatccgatattgccttacctcaactgccattttcagaaaatgtatctgtattcgatacccataagctcaagcagacagcaccatgtacaggctgcttttcctgctggatcaaatcaccgggagcatgcatattccaagacgatatagcttcctttacagcttccatgaaacaaagtgatacgctttatattcttacagagaatgtatatggctcctatagtccgtttgtgaagtgtgcaatcgaccgctctctttcctatgtgcagccgtatttcaccattcgcaatcatgaaatgcaccatgtgttaacctctcccactcatcttcagctgattgttattgcatatggcagtgagaatgaacaggaacaaaacgtccttcaagctcttgttcaggcgaatggagtcaatatggattgcaggtatgtccaatgtcatcactgcgcggatagtgaaaaggcacttgtccggttacaaaccatgttggaggtggccgtttaatgaaatacgcaatcctttccggctcaccgaagccatcaaacagctgcagtgaaatgctggccaaacatctctttacagatatggaaaatatcactgttttccactgtatggatatccataaaaatctggatatttttcatcaactgcaatcctttgataccattgtgctaagctttccactttattttgatgcgctgccttcccatcttctcagctttcttctgcaatgggagaaggaacgaaagcgtgcaactgtaaaggtgaacctgtatgttattgtaaactgcggcttttttgaaggaaagcagaatcgctatgcgctgcaggttgtggaaaactggtgtactaaaagcggtatgtgtttcatgggagggattggcatcggtgcaggtcccatgctgaatgaaatacaagcaatggcatgggagcatggcccaaaagctcctgtggataaagcccttcgccgtatgagagaagctattataacggatactgcattcgaaagttcttatgtccagcctgcctttccgcgcagtctttatataaaaatggcacatcattcctggaataagcaattaaaaaagaatggctatgatccaaagcgtgtgtatccgaaacggtaagccttttgaaagtaaaacaattctatgcttcctattctcttgatagtgaatatcgtataaatacattaactgccatccggattccgtaaaaagtgaatccaacagaaaaccgtcatagacagtttcctcttcctttcttacggtattgttgatatacagcctgccgtaagctttcggggtatctctatgacggttattttatatgcagtttttcttcaggaaaataaagctttgattcctcttttaaatcagctcttgttaatgcacgaacaatatcactggcctttgacagctccttaaccttgccgctttcctcaagtacccagatattatgtccgctttcattgctcttataaggagaatacggcttttgtgagacaacatcctgataaacataatagtccggatcgtatcccaatgcctgtacatgcagctgaatacgctctaaatcctccggatttttcagtgttacatattcaaacagctttcgatttaagagtcgataggatatatcacgcaggatttcatccctgcaggttaccagctcagagaatccatacagggctgcggattcgtccagacgatacaacgcatcaatgcccgcatccgcaccacagaggaatggatgaaacatttttacatcactcagatattcaggatgcagagcatacacctccttcatcctgcgaaacaggatagaaagcagggtttcatagctgcgtgccaccggatgcagatacacctgccagtacatatggtaacgggccatgatatagtcctcaacgctatgtatcccgcttgcttttacaacgattcttccattctttacacgtattgttctcagaattcgctccagatcaaattttccatagctggttccggtaaaataagcatcccgcagaagataatccatacgatccgcatccagctgaccgcttaccagctgattcatacattcctttgcatggcggtactggataatactagcaacatcctccggcagccgcgcatcacaggcggcaagtatctgatgaatttcgctattctccatgatgattttcacggtgtactcttcatgcttatacgtactgattccctcaaaggcgtgggaaaacggaccgtgtccgatatcatgaagcagacctgccagcatcactaccgccttttcgtagtcactcaatacctcccgcagctgatcaatttcataaaccatgcgccgcacaatttcataaacccccagagagtgggagaaccgtgaatgctctgccgtatgataaacctgaaaatctccccccagctgatggatccgtctcagacgctgcatttcctttgcgttgatgcaatcccataccaccttcagatccacatgaatatagccgtgaattggatcgcgcagaactttggtttcttctgttttaagcataatctctcaccctcttttctattatcattatactataaagcgctgtgtaattataacaaattatggaatttagataagcctaagaattaactgatataaatacctgtgagtaaaacaaagaaaatcggagcctctatccgatcttcctttctataaaagctatgagcctgccacatatcctgttttctcaatcagctcttttccttcctttgactgaatccagcttagaaacggcttcagattcttattcgtattccccttcacatagacagcataaaacggactgctgatcggatatgtatccttgcggatattttcaacgctcggttcaatgccatccaccttcagaagacgtattcccttgtttttcaccatcccctgcgtataatagcggaaggaatagccgattgcattttccctgttttcgtattctgcagtttccgttacgatatctcccataccgcttgccacatccttttgcggtggcgacatcaatttctttccctccataaagcgcagcaaagccgattgcgaaccggttccctccggacgctggaaggctcgaattcgttcattattgccaccgacatccttccaatttgtgatgttaccgctgtaaatatcctgaatctgctgtgttgttaatgattccaccggattctcagaattcacaaagaatacgaaggcctccataccgaggggaaccatgataagctcttttccctctttttcaaacagttccctttgcttatcgctgggagctgccacaaaaataagatcagtatcacccttcagtagattttcatatgcttccggggttgttgtacatcgcacactatctgtactatcatcctcatagccttccctaggatacactgcctgcacgaaggaagcatacaccgggtataatgctgttgcgccgtcaagccttaaaagtggctcctgcatcgaataggagctttttttatcaggaactgccagcttatcgctatgaaacggttcatattcaaacaaatcaacctcactgcgcatcacctcaaaccggctctgccatgcatcatatgcaaaggtcccgcccagtatacagattcccagaatcacagggagaatcagcacaagctgtgttttctttttcagccagcactgattccgctgttttgatatcagcatactccagaggtagacaaacaccataatcactgtaaacataaaaaccggtgacatatatctatgtgcagttgcccatgcaagcatgagcgcagacattgaaactatcggtagtgccacaatcgttatcagcgtaagcagtacgataaagaatgcccacatcataaggcgttctcctgaagcatgtccagtataggttgatctgctgcttcaaattgatagctgtaaagctcacgcggcgttaccaatgcatattcatgatgggcatgcagatgaatttcgccacttacatatctgcaaagataggcgtgtacaagcagtgtgtaatcctctctgttatcgcgaatcgttgtaagatatctgtcgatatccacacacagctccagctcctccctaatttcacgagctactgcctgttcccgtgtttccccgactctaccttgccacctggaaattcccagatgttctcatgtacaccgctgcttcgcttcgcaatgagcagacgctgatccatgcaaattacagcacatacgatatcctttgtcttcacgcttattccctccaatctgtaaaatcctccggattcacatcctccttttgtctgacatcatccaggtaaaaggtatctccgattctttgcagcttccaatattccacaaaggttgatgtttttcgtttaccttccgtaattgtttgcgtctgtgaatttatagtgtaatctatcatgcttccttcgatatacagccagcaggaatcctgactgtcatcgcgataatcctgaatgccaaccaccgcacttcttcgcagcttgatattatccagaacattgcgctcattgcgcagctccatccaggtaagacgcatcttccactgctcatacaaatgttctgtaagataaggcttcaaatcttcaacctttgcattcgtccatgcatcctgtacatgatagtaaatatcctctacccgctgctttatcagcttctcattccaaatggcatccgtatcttccatccgatgcagcagggcagcactttgctttgctttctttttcactcttctacgataggcaagcatcggcattgcaggtatcaatacaagcagacctcctatggcaatcgtagagaacatactgccaatcgggtcattgtatccacgtccgtaataatgatcggaattcgtactgcctgatgaggaaccgccactatagcttcccccaccgcctccggaaccaccgcctcccgctctcgcatacgcggatagcggcaataaaagcggcaggataatcaggtagacaaggcatttctttttcataacatcaccctttatatgttcattatacaggaaaaacaccagataacaaatcatgaaaaccaacagttttttaagaattgcttcttacgcaattcattctctttctctgttcacaaacatgcatatgtgctatatttaagataagaatggagggattgtcatgaatgtagcaaccataggaacaggctttatcgttgactggtttttaacggcagtgcaggaaagtgccaatatcagctgtgttgccatgttttcacgtaaggaatcctcagcccgcatgctggcagacaaatatgaaattgataaaatctatacgaatctggatgatatgctgaaggatgaggaaatcaatttcgtctatgtcgcatcaccgaacagcctgcattttgagcatgcattgaaagctctgcaggcaggaaaaaacgttatctgtgaaaagccgttcacatccacggttgaggaattcgatcgtctggttaaagaagcacaggaccggcacctgtatcttttcgaggcgatcgtaactgcacatatgccaaattatctacgcatgaaagaagagcttccaaggcttggtaccattcggatggttcagtgtaatttttctcaatactccagccgctatgacaagtttctgcagggggaaacaccgaatgtattcaatccggaattctccggaggagcactcgcagacatcaatatttataatctgcattatgtaattggattcttcggtaaacccaaaacagtgcactactatgccaataaacatgcaaatggcattgatacaagcggtgttgtacttatgcaatacgacggctttcaggcggtatgcgtcggctgtaaggataccagaagtgaatgcattgcacagattcagggagaaaagggatttatcaccatgcgttcggaaacaagcagatgcgctgcctataccattcagatcggcagggaacgtgctgagcatccttccatcgtgcagaatgatgtagctctgtattatgaattacagaatttccgtgatatttataagctggatgactatgagcgctgtacacagctgcttgcttattcaagaacggttatgaaggtgtatgaagcggccagaagggatgccggaatcgtatttgcggcagacaggaatggattatgagtgtatttgaaaatgactggatcatgcggcagattgagggcatgaccgacatgctgggcaaggtgcttttacatcgggagaaaagtgaaatcagggtggaggaggagctcagtgatgaagatgtgaaaaaatatcacagacggatacaggcgctgctaagggaaaggaaataccccgaagctgtacaatatttacgtgaatattttgcgaccggcagtatggaatatctcaaggttgcactatctgcgtttgatcagctgaattctttgagcgaatccgagctacaggaaggcggctatacacggcaggagctgtataatgacctggaattcattacgcaacaatatggtatccatctataaacgagcaagacacgaatgagcttgcaatcatacttcagcgtgaagtggtacaaactaaaagcatacgtaaaagcaggaaattcctgtctatgtccttaaaaaccaatacagctttagtgcaaaagacgcaggccacagcttgcgttctttacgtttcataaacttcaattaaaaaagcagaaaagaaaacgatctctatatgataaacaaaataagcctgtttacagaaggactcattcatgataaggaacagatattgcgttaaggtgattgctttcaaatctattccaaagcaataaacatctcaagcagcttccttccatactccgtcccaccccatagatcctgcagctttttgtgtacttcatcatctgtaagaccttctcttccggcctgactctcaatgatttcttgtatgaccgccagcccgtcgctgacatcgatatgcaaatgaatcaattctattagcggacagataaaacgttcactaagtgtcattttgctccatagactgcgggcaaccgtatgcagctctcttggaatttccggattggaaagtcgttttcggtacagctgaaaccaatgctcgctctctttcatggagattccgtacttcgcttttaaaagctgtatcaaaagacgaatatatgggtccaacctgttctgaatttcttcatccttcgctgcttcatataaataggtatgctgtttttcaagtgcaagaaatgccattgcatctgcataggtattcagcagataccgcttgcgataaaagtgggagcgaatatttgttatcgacggtatcttggcgattcccgtatctgtcaccacgtctgcatcgacactgcattcatgaaacgattcactcgtaacctccataatggtggatcctgctgcgcagatgcggtcaacaatcgtatccggtatgcgaatcacagacaggtttttcctctgttgttcatttttcgcataatccataagcagagagtgaaagtatgcccctacaccctccacgttctcacagcaaagaaccatacgccgggaatcactttccgtcccccatgccatggctagaacctttgcgacatggattagattttctctgcggactgatgtagtcactgcatcacatatatgcaaatatgcaagaagcatcgcttcatccgttacaggtgaaacgatatcttctattttaatggtatgcagtctctgttgttcatcatctgaaacatccagtgtataggactttgcatccttcattttttcaatcagcatcggatttgtatccgcaagcacgatacggcagccgctctcatacagcattggtacaaccaaacctcttcccaatgcacctgcgccaaaatggacgaccagcttcttctgtttcatggtcgatactccttccattgctcctcagcctcctgtggatgcgttacaaaacggaatctttccggatttttctcatactgcgtatagattggtaccccctgctccagatgaaattccggatatgctcttgctttcagaatttctagctgtgcagggtgatattgtgtattctgcacaaaggtgatactgccatcctttacttttgggaaaaatgcaactcctctatgtgcgcgaacctgctcataatcaaaatcataatcacggacacaccatgcaccaaacagcatggccctggagggatccgcgttgattgtacaatgtgcccaccccggcggtacaatcactacatctttggttctggcatgaactgcaaagcaacgccccggatcatccccggcatattcctgcatatagatataggcctcccctgcccagatttcatatacctcacaggtagaggcattacatgagactgacaccgcatggatatgcccctgagaacgaacaggctcctccccgataacccctttttcaaaaatcatcgcgccatacaaaagattgcggtcaattaaatcctgcatatgcttctttttggctacatccatcgcaactgcataaacaatggacggtccttctgcattcggatcactcaagcttgcacgtatatcatccagtctacgcttctctgtaagcggtcctgtcgtagctgcatcatatataaattccattttgttcagatccacagacaaattcattcctgtatttaatttcataatcatatcctcctatacacgcactcctgctttccttactgcgcttcgctttctctgtgattacaccgtatgtttttatcccttaacggtttatacactacgatagatgcaatacgggatgcttatcatacgtatgctttttccttcaacctcatttttcacattccttccaaatgtatgaaaaacctgtcggcatgccgcctactgctcagccaacaggctttttcgttataagtaaatggcgattttgctgtgatggcgtccatccattgcctgttcaaaggctgtctgtactgcttcaaacgggtatctgcccgttataatatcacgcacttgcaggtgctgttcccgaaataatttcaaaagtccgggataggtattcgtatagcggtaagagcctataatgcgaagcccctgatatacaatatccttaaagctgatttccaaaggacgatcactgacaccgagttccagaagtacggcctgcggtatgctgtgctgcagaaattgcttcaccacctcactgttcccggttgtatcaatgatgtgggtaaacggcttcatagattccagttcatacgcagttcctatcagaaactgattctttttcatatgcagacgctctcctatgtcccgcttactctcataaacatccactagatgaacgctcacctcgggatataattcctgcatcagcactcccataagcagtccgatagatcctgctcctaaaatcacaagcctgctttccttgtgaaagtccaacttttcaatcgcgctgtatgcaacagataacggctccagcagcgcaccttcttcaaaggacatggaatcctccagcttatagattgagctttgcggccacttcacatattgctttaaagctccgctgattcccttgctggccatgaattgcaatgattcacagaaattataatctcctctttggcaggcctcgcaatgcccgcaatagctctgcggctccactgctacacgatctcccttttgaacactgcttacagcagtaccggtttcttttacgatgccggccatctcatgtcccagcaccagcggatactgtaaatcatgcggcagcgtttcagcctgaaagtagctgagatccgatccgcagattgtaacaaccttcacctcaacaagcacctcatccgcctgcagagttagatcctcctgtacatccgcaatggcaagcaccccctgctgtttcaatactgcctgtttcatactatctccattctcctgctgtatacagtacagctttcctgctttcccgttggatacttcaagttttttaccccttatccaccaaatccaaacagctgacctgccttgacaaacaaccagagaagaatatttccgccttcatcccagttggtaaacattgcgccatttgctatctgatctgtaaataaccccgtcatgctgcaaagatcggtgcatattcccgccagagaggaagcaatcagagtggcaggtatgatccaaagcgttgcacatattaccgtatgaatgatatttccctttgtatacggcaccatgccgccaatccagtatggcagagccgcaagagatgcaaccggaagaaagttacagcccggaataaccgctgcaatcataacggaaatcggatacatcaggattactgttgacataacggaaggatcccccagcagaatggcagggtctactgcgatatacagctctctgccaggaaatttctctctcatgaatttagacagtgcattggaaatcggtataataccttctgcaataatagacagcattcttggaagaatgacaagcactgccgcaagcttgattgccagctgtgccgtattaataaaatcaaagccggcaacgattcccataacggtacccatcagcgcaccaataacagacatttccccgaaaattccgaatttctccttaatctgttcggaggatgccttgatatcgcgaagccccggtatcttgttgattacccacatacatccctgtgcccaggatgctgtaaaggtacctgaggtcgcaacaacagaaattccctccaaaccgttaaactcctgtatttttttagcgtgataatcggcaagcttcatattgatgacaagcaagatcagaccgctggcaacaccgatatagatatttccggtaaatgcccacatcataccggcaacaaactcaccatgccagatattccacatatccacccacagcgtctttgtccactttaaaacaaccatgatgaaattcactgcaataatacccaaaatcacccagactacacccggccaagcccaggctgcactgacatttccatacccgatatcaattacattcagactcaatcccagattatttacgagtgattctgtaacaggtgtcatcgctgcaacggaataatcaacgatcagccccaatccaacaagcccaacgcccatatacagggcactgcgcagactcttgctcaaaccgcccttaaacaccatacatagtgtgaacatgatgaacggcacaaacacactgctgcccaaggcgaagaaccagtcaaaaaaattctgtagcatttccataagtttctcctcactttctctgcttatttatttttcaaaatatcagccactttatccacgacacgctcctgaccatcctcatcccccgtcagaaacgatatggcattgataaccggaaaatcatatttctggcgaatattcatggaagcgacaagcacggtaatacgatcagcgtaccgtccgatatcgtccagtctgcctaccttgatttccacatctgtgattcctcttttcttcaagccctgttccactccctggctggcaataacggaagtcagggttcctgcgccgcatacaactagtaccaatgggttacgattcatactgttttcctccttctaatcgttctctgacgatttgttcaatatctgtttcctgctctgcccgcatcaattcctcgatgaatgcttcatcctggcacatgaggatgattctgctcagcatttccatatgtgcatgtgcctgattcaaggcaagcagcagtacgacatccacatccaccagctcatcacatgcatccatgcggtgaaacgcaacactttttttcaaggtggcgataccgatacacggtacttttacatactgcggctccgtatgtggtatagcgatattgcgttttcctatcagcaatccggtaggatacttctgttcccgttttaataccgcttcctgaaaatctgcattcacaagatttcgttccttcattcgcttactgagttcctgtatgatatcttccttctgctgtgctgcataatgcggcagaatacattctctgacgatttgtatttcctgatccaacagcttcacctcccatcatgttttatccttcacccataaaatagcaaaaaccgtgccaactaattggacggttttgtgtaagtggctatcagccttatgatttcctgcggcttctgacaagccgaaagtgcctgaatcagcgttgaatcgctgcatatggagaacaattcctgcgtgtatgcaatactctcttcctgtagtgccggcatcaaaatgatattcgtttcaaagtcatcctcccataaagttgcatcctgcagggtcagaatagcaatggcaggttttgtgacatgttctgtaaaaccatgcgggatagctgcctttcccataatggttgcgcccattgcctcccgtttgtatacatccagcagatattcctgagatacatattcctttttaacgagtaggtctaccagtttttccagaatatcatttttacataaagcatcctgtacatgacagagtatgatatcctcatcaagaagctcctgcaggcaattcacagtctttccgggctgtctgttattttttatgatgcttagcagctcctgctgtgctgttccattgagaatttcattcgtggataaaaatggtatctggtgatactctatctgaaagtttcccagtatcgctagaatatgatagctgcgagcaaggtggtccagttcaaattcaattccgttttcactgatgacccccagtgtcagtattcggattgtcatgttatgctcctgtagcagcttttgtatttttgactggatgaggaccgcgctgcccttacctgtcagacaaatggaaacaatcacagtctccttttcttcaagctccagattaccatggaaattgatttccttttccatattcagtgcctgttccaattcatccagcgttgtttcttccagaattgctctgcgaatcgcctctatgaccattaccgtgtctacacgggagattgttcgtgtgtcaattcccgtacgctgcgtaattatctgaccgaatgttaccagtgatcccatatctgtgagaattaaacagcccctgccttcatcaagctgttccactgcatgctgtgtccgctgcagggcatgactgcttggttcatccaaggcacagcgaagtccaactgcaaagctagcattcagcagctgattggcgacctccaccatttcgataccgacattgccatgtgttaaaacaatgattccgattttccctctgctttcctctttcttctttttggtaaaggttttaagatacatggcgataaacgctatctcatcctccggcagctctaacatgaaatcctcatgatactgcatacacatttttcgtgcagtggcaaattccagcggatactctttttttattttttcaagctgtggattcataatacgttttccacatttcatacgttcatagcttgcgctcacatgcagacaaaggggcgagagtatattgggactgatatcctgcatgctcatcctggcgatatcaaccgatttctgtacggattgaataatacgattacccacaacctcttccagattttttcgatcaacctgctgatattttattttattgaacagattgtccatctctgtatccagttcttttccaagtgtctgataaacctcatgttctgtacatccctcattcaaaagggcttcgtatttttcttctatgaactgatagatattcggtcccatatgcgccaactgttctcttggttttgtgcaggaaacaaataaatcactttcacacagcttccgggattcacgtgatacggtattaagcgcgagattacctacatggggtggcaaatcatccagcgctataatcagctgttcatccccatatgtaatatgctttaagaagcttcgggcacaggccacctgaatatcacttcgcagctgtccgatattgcccggacacggataattcagtaaaagccgcaaagcatccctttccaaaataatattctgctgtattcgcagagcttcctgaaacagaaaggctttgataatcataagacgttccagaagcgggcgctcgctcaatggcggcaaatcgatcagcatgggaattctgcgtcgaaaggttgtcagaagataggaatccagatcctccgtagtggcagcaatgataagaagtcttgccgttcttgtattatctgtttcccccagctttcgatacatccccttatcaatcagatagaacagcatttcctggccttcgcttggcagacggtgtacctcatccagaaacagaatacctccgtcggctttttccacaagccctgatttctcatgatccgcaccggtaaaggctcccttcacataaccgaacagctgtgagagtaagagctctgaattatccgcataatctgcacagttgaatatcaccagcggactatccttctgtatggtacccacatgaatggcgaagtgatacatggcttcggccaactggctttttccaacaccactggggccatggatcagcgtatgaagacctcttggcggataaagaacagcagcctgtgcctgggaaatctgccgcttcatactgccgtcataaccaatcagctgttcaaaatcacgatccggatccatttgcaggcgttcctcttttttcgctttgggctctagctcatcacgcactgctctagcaataaatcgcgatatctgatatccccgatcattcagtatcgctgtaagcttccggtctgatattttttcgtttgcctgcaatatttccttaacctctggtagtaatatctgccttctccgctcccgggagtctaaaattccctgttcctgacgcagaagtgtaacttcctcacgactcatattgcaaagctttgcgagctgctcatccgtatatggatttttcctatcctctttttcaatcaattcctttaccgtgttattcattataatctccctctattctgtttcccctttcattccccttacttttatacatattacgtgtttcctttgtattatacaacggatattatacaaaaaatagtaccaatacaacaatccatgaaatcggaaactatgtatatggcaaacagtcgttcccaactttctaatttatcattgcaaataattatttttataaagatcaacgttttatactgagctttcttagtatttgacatgtatggtgaagctgccaaagatattacaaaaagatctgatcgtcatcatgacataccagacctttttcatcagattgtttttgactttttccagaataccggcagcatcatcaccgcggtaaaaaacagaatagctgcaatttctatcgtatagcgaaattcatggactcccaaaaacagcagcagcaaaacaagacacagagccagagaaagcttcagatgcagctgctgctttctacgttccagcatcgtcttatagctaagacacgggccgaaataaatgaaaataccaagtccggcaggaagaaagaccagcagactgtatatattcagatactccacacagagtaacaccagcagatagataatcatcgttatcagatagcagcgtccatatgtttttgcatgataaccgccagtataacgtttcaggaaaagcagcatgcacagataaagcaccgtttcccagaaaaactgcaggaagtatcccagtatgagcatactgacaatctgtattccctgtgtaagaagaagttcaagggcaaagcggatgatatccacctcatcctcttcaatcagacctcgttttgcaagaaatatgctcatccttctacttattgtttccatgcttctgtgatttcacagattcctttttataggtaaaaggctttggcataaaatgtccaaaaactgatgtgtttgatacattttttaatgcataatcgataagttttttcttaatttcaaatttcatataaatttaccaacctttcttattttggaagaggcatcagacagtgcacacttaccgtatggctttgttcatcataatcatatttcaccataccttcatattgagctgcaatacgctcaatgattttcattccatacccatgtccagttccttttctggaatgaaaatccggtgcttgaacagttgaattggtaacctcaataatcagagaatcgttatgtatcattaactttatgtccaccttcttatgttcactacccctagcggcatcaatggcattatccagcatattgaatacaagagcacacatatccttatcctcaatacctatttcgtcatttacaaatgcactgacctcaaactgtatatcattatttgattcaattttcgtattcagacacgcatccagaaacatattccctgtcttaatacgttgtccaagctcatctacatcttttcttacacgatccagataattcaaaaaatcacggtcatgatgaatgctttccagtatctcaatatgatttctcatatcgtggcgaagctctctgtttttctcctgctcctcttgtaaatcatgcatatattgattttgtatatttcttgaaagctccgtcagttcgatttcactcttctcctgagcaagcagccagaatcgaacaaaaatgaaatctacggtcaatgtctgcactaccatgagcagaaatacaaagaacatagcgagatcctttggataaagctccaactccctcatgtacatcataaggacaagcatgaaaaaaatttgtagaaaaacaaatggaagcaattgctttcttgataatacaacgaaaaatctacgatacagatatactggtatctgaaatgctattgctgcacagacattagcaaacataatggaagcggtacgcaatatcccgggtacaaaggttgcatcaaatgccccgttgaataaatggatatgagcatacataaatatttctataaaggtcatgaacgaaaccgtataaaacaatagataaaataggttcaacagttttatttttctgcataatacacagataaacaaaaaatccggaagagtagagaacatgttggatactaaaaacatgatatcagatacatcaatattattggtaacaagcatattgatatagctgtatccaataatcagcagcaccgtacgagtattccattttacatcattgtttactctgataacgcagaaggctattcctacaatataaattaaacaatacacatattccataacttcattcataacatcactcttttcctgcacaactattatataagaaggcctgtatgatgtcatgtaaaatttaatttttctatttctcttgattgagataccttttcccttcccccttcctaccattattatactacaatataacgaattttcggtatactatttgcatgaatggcctttttttttgtattcaatggtcttggtaatccctcctgtttttcataaaaacacaccatctgtaatttctatttattccattccatgggatttacgcaaaaagcacctatagcaggtacagtgctgttatcttactgtcctctatagatgctatttcaaacaatttaattccaggatatgttatgaaatacatatttgtatatgaaaattagtataagaagggatctgattatgataaacacaataattgaaaagacatacaatgctttcttaagtacatttaattgcttctgaagcataatttggtggacctcttatactgctgttatattcactacatttggaactgtgtatacaatgtccgccgataatcggcagtcaaggaactcatgtaatagaaaagagtgccttgtatcatcatacgacatggatatgaaaaaacaccgctaacaaacagacatgcagaaaggccggggctttgcagttgtgatacatacatcatcattatggttttcatacttgttttcatgggacagcccctcctttttttcgtatttacagtgtagcacaagcggctataaaaacacaacaggtatcctcaaaataggaattttaaaatcacctttttatttaagagtaacctggcaccacttattccaatcatagtaatcacctcatgttcttgtcagcgatccttgccgtgttcatgatttgaaagtaaaaaatgacggcatcatagctttgtcgtcatttgaaataaagcatccataatttcgttcttacgccgcctgctgatcttcagtacgcgatcaataccctttacatgcagttcaaacccgcgaatggagcggatatattcgatgttcacaatattggcacgattgatctgaacgaaacggctgtttaattcattcatcatgcgttccatggaatacatgcgaaatatgtattcacgatccttggtatatgcatagatgtccttagagaaatactccatataaatgatatccttttgtgcaagcatctcataaccgccatcagtacgtatcttaaaatcagcgttatcctgtaaaaactcaaaagcatcctgcagcgttctcttcagcttttcatctattttggatttcagaacatagcggaatacgttgattccaaatgcatcctccatacgatctgcataattcgttacatagatcaccagtgtccgttcattggcaatatactttgccagatgaatcccatccatgcccggcatttcgatatccagcagaagtatgtcatatatatgtttacttctcaaaaaatcatttacattattatacgtatcgatgaaaagctgttcctctaatccaaaggcctctattttatcacgaatcatatttgtatagcatggttcatcatccagtaatgctatatggtaaacagtctgcatatatattcccctgtcttttcttttattgccattaccagcaggcaatgctgctgtcggttcttgactcacttcctgccataaatgttccattatcaagccgcacaataatctgcccgcgtccgaagccggcagtctccaaatcaacctgaagctgatgaccgcgctcctgcagctttcttgcaatgttggtatcaaagctgtcctctatgataaattttttatccttcacccactgccagcggggtgcatccagtgcctgctgtggattcagatggaaatctatcatattcataaccacctgcacatgtccctggggctgcatatagcctcccatgacgccgaatggaccaactgcgtttccattccttgtaagaaatccgggaatgatggtatggtaggtacgctttccgggaacaagagcattgacatgattgggattcaaagagaaatcatgtccgcggttttgaagggcgattcctgtgtcctttactacaaccccactgccaaagcccatataattgctttgaatgaaggataccatatttccttcgctgtctgctgtacataaatatacggtaccgcttttcggcggcatgtggaccgcaggctgttttgcaaaagcttcgatttcctgcgaacgctctctgccataggctgcatgtaacaggctttgtaccccggttttcatatatttggcatctgtaatatgatgcaagccgtctgcaaatgccattttcattgcttcaaactgatgatgaaacatttcctcatcccgctgtgcaaactggaattcctttaatatattcaatgccatcaatgcaacgattccctgtccgttaggcggcagctcccaaacatcatagccgtgataatgtactgaaaccggatccacccatattgccttatgctgctgcagatcctttttccgcaggtatccgccgtgtgcgatactgtcttcttctatacgctgtgcaagctctccttcatataaggcggctgcctgtgtttccgctattttctccaatgttttcgcatgatgcggaagctttaccagccgtcctacctccggtgccattccctgaaaggtgaatgcctgaaaccattgtgcaaataccggatcatcctttttatccgtatagcttctgacagccatcttccacattctggaaagttccggcggtaccggatatccgtcacgggcataggtgatcgcaggtgcgagtacctgtgcaaagggcagctttccaaaccggcggcttaattccgcccacgccttgggtgctcccggtaccgttaccggtgtccatccatgcttcggcatttccgtgataccctgttccttcagtttttctattgaaatttccataggtgcacagcctgagctgtttaaaccgtacatggcatccttgtaccacacaatggcgaaggcatcggaaccgataccgtttgctgtaggctcaacaacggtaagtgttgcggctgttgcaatcgcggcatcaatggcgttgccaccctctcgcataatctgcaatcccgctgcagcagcaagattgtttccggttgcaacaacaccgtttgcggctactgtgggatagcggcctctggtatagggctgatgatatatattgaacataagtaaacctccatatgtattattatatagtgtagcgctttctcttacaatcccaaaaccaggggaaaatacctcacagttcttgtatttatgtttgttttttgtataatatgggtattctttatatggaaatgagggtgtttatgaaaatttactgggaactgttttctgtctttatgcggatcggagcctttacctttggtggaggctatgccatgctgccgctgatacagaaggaaattgtggataaaaaacattgggccacagaagaggaaattatggattactatgcggttgcgcagtgtacaccgggaatcatcatggtgaacacggcaacgtttatcggcttttatgagaaaggaatccttggtgctattatcgcaacgctgggtgttgttacgccaagcatcatcattattctgctgattgcctctgtgcttaccacctattcctcacttgctattgttcagcatgctttagcaggtatccgtgtcgcggtttgtgttcttgttttaaacgctgtagtcaagctctggaaaagcggcattaaggataccttcggcatcttgttatttgccgttgtcctagccgcaatcacctttaccagcgtatcaaccgttcttattgttatcatcgccgcattacttggtgtgattgtctgtgcacttcgccgcagggaggtgaaggaatgaatctggagttattgctgcttgccttctacgaatttttcaaaaccggactgtttgcccttggaggtggtctggctaccataccgtttcttacggaaatgatgaataaatatcactggtttactgcagatatgctgaccgacatgattgcggtgagtgaatcaacaccaggtgcaatcggtatcaatatggcaacctacaccggttatcatatcaatggtgtgctgggtggtatcgttgcgacgcttgggcttgttgcgccaagcatcatcgtgatctgtatcgttgcgcagtttctgaagaagtttaaggacagtgagctggtgaaatccgttttctacggtattcgtccagcagtcactgcactcatcgcctctgccggtataacgattttcatcgctgctttatttcaggatagtgaaaatttcatggaaatggtcaaatggccgtgtatcctgctgtttgccgttatcttttatttatcgaataaacgcaaatggcatccaattttgtgcattgctgcttccgccgctgtgggtatactgtttcagctgtagaatatatgggaagcttcgctccctatatttgcaacaaattatttcatattcaaaacgattgaaaatcgtaaaatcgctaatattttaatttatatcaaagaaagtgaacttatagatttcaacgatattttatccatattcatcagaaaaagaaggggtctttcgcattgtgtgaaacacctcttttttactatacttcacccatgtctaatctatctctgttccttattaacagatagatttcctatcataaaaacggaaggatatccaacaataacggtgatagatattgtcggataagatatttacaccgaaaatatcttaagcattataatctcgaaatagattctccgctcatgatttgtgttagcagtaaaagctatatctatcttatattcaaaaagattgtacttttaatcgtgctaagctcaatcttatatagaataataaagtttattaaagaaacatcagcatatataacgggtaatcctctatcctttcagatatatttaaatttctgatagaaaagcgtaatgctcttttcggctcatacttatctatatacgcttttagacttcttgcccttgtgttcatggagcttttcacttcaatcggtacaataccacaatcctgttcaataatgaaatctatctctgaatgagaagacggttcaaaataatgcaaactgtatttattgaatgtcagcatctgcgccacaatgttttcatagattgctcccttatatacacctaactcattcttcagaatatcctgcatcacagtttctttgaactgagagagtaataagccagtatcactcatatataacttatatacagaagattcctcataggcctccatcggtacatcgatacattgcagccggtaacaaaatgaaatagtcccgctgtctttcagccactgaaggctgttttcaaaatgcgctgcctgtcctccctttctcacgagcttatattggaacttcttattttcttttgcgagctgcagaggaatggaacgaaaacattcatgtgttcttattttttctgatgcatctgcgtattttgccatatcccgatagtagccttctacgatttgctgctgaatatttcttgtctttacaaaatccccggtttccacaaaggttttcaccgcttccggcatacccccggttattatgtaatttctgaagtgcttcatatattccttatgaataccttcatttactcttcgcttttctgtataacattccttaaggtaggaaatatgttcagcttttaagccaacagcatataaaaattccataaatcccattggttgcatttccatggattccacatagcctacaggataggaggaagtacgattcacagctactcccagcagactgccgctcaatatgtaatcataaggtgtttctgtacctagaaatttgatggatgtcaacgcctggggacacgcctgtatttcatccaatataactaaaatttctttagccttccaatctgcttcagggaagaaaacctgcagattcatcatgatttcttccggtttcgatgtctgttcaaaaaaagctctgatatcatcatctctttcaaagttaatatatacataagataggtagtgttttttagcaaaattaagtatgctgtacgtctttcccacctgtcttgatccagatataagtaaaggtttatgattttcctgctttttccactttaagaaattttcttctatcattcgatacatagcaccactcctatgatagtagtatactacatttgaatgcaaacgccaaccctgtgacatttttttatgaacataaaatcataattatttttatttttgtgtacataaaataataagtttttatgattttatgaagataaaaccattttcacccttgttatcattctaacatagctgtttatgattattaagctatccttcaacaatctcttaataagatgtcttatcccatcaactgcaataatcagttaccttttttaccagcttcacttttacgattcgattggcaatacaatttccactgtaaatattttatgattaacagttcttgtaataatgccatttttctccttcaccacttcacaaacacgctgaaagccgattccgtgcttttctttatcttctttacttgtaataagcttctgattatccatatggatttctcctatattacagctattttctataataagcctaaccctgtccgctttttttattgttgaaagctttataaaccttttattttctacgtatttttgagcctctatagcattggcaacactcatctgaatcacacaaagacaatttggatgtgatagtacctgtttctctcgtaccagatatgtaaccggttgcccggaagaactcgtcatagtcctctttggtgcaacctttaataaagatatgacagcaacgctcgtcgttttcatcgactatataaatacgctccacaaaggattgtatcagcgttaccagtacatccggctgtgcgtcctttgcgtatttctcaaaggacagcagccgttctttgatttcttcaatatctctcacagcatacatctgactttgcctgctgtcttctaatttttgtaacagtttttccgtttcagaaagctcgtccgtcagcccttttacatcatcttgaataaaccgttttagattatcgtctgcttcccgcagatttttcacctgatttgaaatagcagtttcaagctgtgctttcttttttcttagctcggtcaattcctgctcgttctgagaactcttaaaaatatctgaagccttctgattgagtaatttgacaaagtattcgctgtcctcatcggatagattggataactgtttgactacaaattcatcaagcaatacaccgtcaacagcacggaaagtacattcgctcaaacgatagccgggacagacatatttgaatctcggcttgccgtttgtccatcgatttgattcggagacaactcgcaggcgttttccacaatgcggacagtatactagtcctgccagcagagcattagtctttcggtgcgggcggttgtatttttctgcgatggaatcaagcatattttgtgtatcaatccattgctgactcggaataaagccttcgtgcctgccaaccgagataatccattcagaaacaggctttgcagacattaattgcacaaattttggagaaatgaaggtgctgtcagcgtcctcaaacttctcttggtcggttttgttataggcggataagccgttctgaccgtcaaactctgacagctcagcgcatactccgccgccgttttcgtagaaatagttgtaagcaatttcatcagcaacgcagtagacaggattttttaataataatcttgtagtggaagtgttgaatttgctgccgatctttgtgcgatagccaagctcattcatccagtctgctgttttcttaatagaacgggtttccgaaaatacagcatagagtttttgtatcattgctttttcttcgggaatgctctccaaataactgtaagctgatttgtttttgccgctaccagtctttacacgctttactgtgaaacctgtgggggtatttccgccaagccagcgtccgtctttagccagctccatcatattatctgtgatacgctcggtcagagtatcacgctcaaattccgcaaccacagcaaagatttgaatgaatattttggatacgccggaagcgatgttgatattgttggagcagatcagcaaatccaccttgtgcttttcaagaaaatcaagcaagcgtaaaaggtcgctggtttttctgccgatacggtctagcttgtagcagacaatggcacggattttacccatttcaacatcgtggagcatacgctggaaatcaggacggtcggaatagtaaccggagagtcctttatcctcatattccataaaattataatcgtcgtaaagctgaagttctcttttggcatattcagcgcattgcttaaactgtacgccgatactgtcgcctttatttgtaatgcgggactttcgggcgtagattgctacgctacgattgtcctcgttattttgtttttgttttttcatcatagctgccctccttaccgtctgattataccgctatccctgtaaccgtttctattgtgcggcctcgtttttgaaggtcgtatagaagtaagcgtaaggtttcaacatcaaaggcacggatttcctgctcaaggtattccattctcttgttctggaaagtgcgcaatgaattttcataatcgtttcctctgtgaattacagcgttcatcttaaaatccataggcgaacctcctatcttgaatctctgtcacgcaagcgctttcgatggtacgcttcgcagagttttacaatggtttcttccatttgagtggtagtataatcttttggaaaatatttttgaatacgctcaacagggatttttacacgctctttctgattggctttttcttcgctcataatggcggataactgttctttcgtgaacaatccctgtatactgagaacctttaaacgctgtgcctgagataaattaggcgtacaatcgctgtactccatttctgatagcagcattgtctgttcttcaggttgcaaataggaaagttcaacggcgggcgtaaaagcaattctcccttcgtcaaccatatctaaaatgggcgggataagattagtaagacgaatatagcgacgaacttgatttttactttcatctgcttgttgccctatgatttcagcggtttccaacttccgcccaacttggtcggaagttaaatctgtccttttgccttgccgtgatagtgcttccattttcagcttgtaagcgaaggctttctccgatggtaaaatatgttctcggtgcagattgctgtctaccactgcgatggcagcggcgtcacgatcaaggggaacaattaaggcagggacttcttttatccctgcctttactgctgcacggaaccgtctgtgtcccgatacaatttcatattcatctgcggtgttttcttttggtcggacaattaacggagacaaaataccttgctcctgaatactctcgatcaaagcgttcatttcttcgttgtcctgaaccttaaagggatgtccctcaaaggggaaaagtttttctattgcaatatttttcggtgtgtttttcatcgttcataattcctttctctgtttttggcttttaattgtatttccatagcacgctcggtttcaagcaatttcaagatatgcggataccgctcggtgatggattgtgcggttttgagatcttcacgcaaaggttttaactttgcagagatttttcttgccgccgctttgttctgttctttttcttcttccgatttcgggcggcggatacggttataaattttctgcctctccgacttcaaggtagaaatatctgtggattttttctcgataaatgaaacaagctcctgtgcggaatcgatttgattctcacaaagaagtttgtattcctttaaggtttgatctaattttctgacttcctgccgtagtgccggggatagaggttttggggatgacggctctatattgttgcctgtaatcagtttccaaagctcaataatcaatgcaaacgcaagctgtatcccgtccatacgctgtgcttttttaaattcgtattcaagctgtaacagcggtgcataccgttttggaatacgaattgcgtaaagagtaatatttttctgattatcaatcagcctctgccgtattttctcctgcgtatattgctcacccaaagaatcaagacggacagagcgtttccaaccgggagcaataatggagggatgacggtaatcgttgtttcgggcgtaagagtagccgagatttttcaggtataaatcaaagcccttccagttggttgtatttgaaattgcttcatcaatatcttgtttcagaatatctcggtgagttaaaccgttgcttttgtgaatccaataatctttctttcgattgcctgtgaatttactcggcggcaatacgctttttcctcgctccaagcaaactgcgtcggaaatctctctcagcttgtaatggtcggaaatatggttttcaaacttccgcccggtacgaaaagataccgaatttaccacaatatgattgtgaagattatctgtgttcaggtgggtggtaacgactatctcataatccttgccccacatacgccttgcagtttccagtccgatttgatgcgcttcttcgggggagatttccccactacaaaagctttggtatccgtgataggcaacattcccgccgagtttgccgtaacgacgcttagtagccatcatatattcgtatgctctttgtttcggacagttgatacccgaaacatacatcgtttgatccgtctttttatcattctcaacataacggagtgccgcatataaatcttcatccaagaatttcttgtcagtggttttgtcagggttacgggcatagtcgattacttctttcagcctgtttttgacaggccagaatccggtggtcgccatttacgcatatcctccttccgtggtaataaaagttccgaatgaatttcatcaatcagtgaaagcagtttgttttctgtttcgggcgtaaatcccactgtgttgtcaagctgacacaatttgttatagaaatcaaaaaagacatcaggaagaaccgttatcggttcatatcccaatgccctttgcaccagatattcactaatagataaattgcatttttcggcaaatcgtttgattttgtctttatctttttgatttacccgaatgtcaattcgggcaaatttttctttcgggtttctgttcatagatttatcagtcctttcaaaatagggtgttagggacgtcagtccctaaagagaaaatcggctaaacagccgattttgagttggaacttgccgtacaagttccctgcttgttacagcataagacacgattgctctcccttgtttctctcaacctttctcaaataagaaattccgttttttgctctctcaaaagtcagcgttagcattgctccttcttcaatctcagggataccgagatacccggtgttctgccaagcggaagccataactttactgccgtcttcaaaagtgaagtatgcaagaatatttcgtttcttgccccaacgcttgcaatcaaggcgtgctttaaatacgccatctctctcattggtcaggtattcatcaacacaaatacctttttcttcaagttgtcttaatgataaataagctctcataatataaatcctccttaattttgatttgatgccaaaatgatgccacagtgaatttcagagcgtaaaaaagcggcaccactctgatgtcgtcattcaccgagaaacatatcgaggcaatacataagttcgttttcttcttcggacagtgcttcggtgggctgtgctgattccatctgtattacagaaagattttgcaagcactcacgaatagtttttcgaataacctctgttatttctgtgtgtggctcataaaattgattgatagcagtaataactgccttgttttttgaatctgctgtattttttaaatgctcccaagccttgcggtcagcttcgttatccaggttaaacctaaggctcattcgtttgatactcataacgcaccgccgtttttaatcaatttcatttccagcattcgttcataccctttggcagtagcacaaatatcatcgtttacagtaatacggctttcgtcatattcagcaaagttacggatcatacaaccgcctcctccgacaatatacagcttcatcagttttgaatcgtagccgtgttcacgcagtctgcggaaaaaactttccacatactcttttgcagtattggttattgttttcaaatagtcgccgtcaatatctgctgcgccgaaacgaagcacacgggtaatcatttcttcgggcggctctgcgtgatgaattctcattagattctcacggatatggagcatacactggtgtgttccaaatttctcggtaaaacagcggtgggggttcggttttttatcattgacgaacataatattcatcgtgccgttgccaatatcgcagagcatatttacacctgaaaaatcggataagtgattgacaatagcggcaaatccctgtgggtaaacatctgcaccgacaatgcggatatgataatccttgcctttgaaattaaagtcaactgtttcgttcttcagcaaatatcgtttgaattcttctcgctgttcgcttacccaagtcagcggaagcccggcggcaatcaatacatcagcagaatagatttttgcaatattcagttcccttgcgactgccgcaagcgtcagaacataatagtcttcatccagcattttatctgccgaaaactccttatgttctgcgccgataagataatacttgttattccaaacaagcagattgtctttgaaaattggttctttatcatatacggtcacacctgcctgaaaacagcagttttccgttttcatatttccttagccgtggtcaataccgatgatatatgtttctttatattttttcattgtgattgtcctccttgattttaatgatttcttgtttgcttcccgaaaaaacagggcagacaccactacttatcatcaaacagctttggtgtccgcattgcatacatagggtgttcttaattttgatttgctgcgattttatcagattgtactgcaccccaaagacctcttttctgcttttgcgcataaaaagaacacctaccgatttatacatcaataggtgttgtcagataattttcttattgctgaatcccaaatcttcaccgctgaatttttcgtaagctaagccaatctttcggattcttttgtgaatagcactgtgcgttttgaagcctgattcctctgcgattttttcaagtgtaacatcatccattcgcattgtgagtattttcctgtctgtttcagaaagagtgtctaaaaactcgttgactgcaatcggttctaatacggtactctcaacattaacactgtcatcaggaatatcccactccattccgtctgtattctctgcatacttttcttttatttcatcaagagattcaatggatatttttgcacgggtgtgataccacttgcggtaaaaatcgattttttgtcggctctttcgataatcaaaatcttcaaagcaacgatattcttccgccacagcaatgatctcattcatattgtgttttgccattattttaggaacgagccaagtgaatgtttctgagatttcttcttcggatatatatccgagatcttcgtctacattgctgctttttaatatctcctgtgacttagggataatcccttcatcttccattcctttaatccaaatagaaactgcgtgcgcatatctccaagacggttcatatcctgaataaatctccctttttgtgccaagccccataaaaggccacaccataaaagcgtaagcgtcgattattacaagcttaaacaaatcactttctattatttctatggcacgacgatcttgaagtaattttcttggatttcttggaatactgtttatttcttttccgcacttatccaaaatgcttttggggatgaaataaaacgcagaaatatattctgcgttgcgaaacggcgtgatctcaccgttttttctttttaataatatcggcatattttgtgcctcctttccagagagtatactctctatttattaaacgacatagaaatctcattttgttcctggattataaaaatattatagcaaataaatttgattttgataagaaccttgatttaattagcaatataatatataataacagtatgtaagctaactaacttacaatggaggtgataaaggtggatgatttgaatttgaaaacggaaaatgctgaatttggtcaatatttgcgttccgtccgacaagcaaaaaaaatatcaattcgtcaacttgcaaaagcggtgagtaaaacacctacatatatcagtgatattgaaaagagtaataataaacctcccgaaagagagttattagatagaataattgcaacattgcatttagaagaatttccagacataaggaacaagctgtatgatttagctgcaaaagaaagaaaagatgttccagcagatattaaagaatacctaatggaaaatgaatcaatattaaaaattattaggtcggcaaaagaaagcccaaacgaaaagcaaatctgggcaaaagtatctcagattatttaatggtggaggaataaaaatggctgaattaagaaaagaagatttgtgggtaatggcggataaactccgcaataatatggattctgcagagtataagcacgtatgtcttggtcttatattcttgaaatatatttctgatagttttgaaagagcttatcaagaaatttctcaggatgaatatgctgatccggaagatagagatgaataccttgcaaaaaatgtgttttgggtgccgcaggaagcacgttgggaaacaattaaaaacagtgctaaagatccgacaattggtcaggttatcgataatgccatgtatgtgattgaaaaggaaaactcttcccttcgtggtgtgcttcctaaagattttgcaagagcatctttagataaacgttctttgggtgaattggttgatttgttatctgaacttgagattggaaacgacaagaacaaagacactttaggatctgtatatgaatattttcttggaaagtttgcacgtgctgagggaaaactgggtggagagttctacactccacgcagtgtagttgagttgattgtagctatgattgagcctcatgatggtcgagtttatgacccttgctgcggttctggcggtatgtttgtgcagagtgaacgctttgtagaagacagagagggacgaattgacggtcaattagctatttatgggcaggaatccaattataatacatggaaactttgcaaaatgaaccttgctatccgtggaatcgaagcaaaccttggtcagcaaaatgcggattcctttcataacgatcagcacaagagtttaaaggcagattatattatggcaaatcctccttttaatattagtgactggggcggcgagcgtttaatagatgatccaagatggagtaaatacggtattccgcctacgggtaatgccaactatgcttggattttgcacatgctgtatcacttagcgccaagcggaacagcgggttttgtattggcgaatggttctctttcatcttctacaatcagtgaatacaacattcgtaaaaacttgattgaagatgacaaaatcgattgtattgttactttgccgggtggactgttctcaacaacatcaattcctgtttgcctgtggtttatggctcgcaataagctgaaaaacggacaccgtgatcgacatggggaaattctgtttatcgatgccagaaatatggaaactgaaccttatgaggacagtcgtacacagagacagctgactgcacaaactattgatgaaatcacttccgcataccattctttccgcaaccatgaaaagaaagcaacaaaggcggatggtacagaaattgaatatgccgataaacagggattttggaagatagcaacattagaagacattcgtgaaaaagattataatttgacacctatgagctatgtaggaactattcctgtagaggaagatacagaaccttttgaagaaaaaatgaaaagattaactaataacttatacaatatcatgaatgaatctcaaaaaattgataatgaaatagtattacaattaactgaaatgggatggaatcaaaattttaaggaggattaaaatgcttttaggtgatttaattgtcaatcatgacagcaagcgtgtcccattgtctgctaaacaaagagaaaatattaagaaaaaatacccatattatggtgcacaaggaattattgattatgtagatgattatatttttgatggaaaatatttgttaatagctgaagacggggaaaatttaagatctcgcaaacaaccaattgcaacaattgttgaaggaaagttttgggttaataatcacgcacatgtagttacagcaaatgaatcttctaatcttgagtttttgtgcttttggttaaattccaatgatatttcagaatatataactggttcagctcaacccaaattaaatcaaagcaatatgaatttaattttgttacctgatttttctaaaaaaagtcaagaaaaaatagctaataaactatctttatataagcaaaaaattgcaactaatatagatcatatttctcttttagaaaacctcaaaattgaaatatatagagaaatgtttattaacgaacagagaaagatagaatgggaactaattaagtttaacgattttttaactccttctacagaaaaaataggaaatcaacaagtgccagtttattctgccactaataaaggcattgttttgcgagaacaaaaatttaataagaatttaagtaaatccttaaagaacaataaaaaggttgttagagatgacttgatttttggcctgagtagagaaatattaaactttggtgtatttaaggaggagatagggtcggtaagtcctatatatcagatttttaaggtagataaagctattattttaccatttatattggagttagaaataagaattaatatgcataagtacatggatattttacagttgggagcacgagaaggacagggaataagaaaagaatatttgcttcaaaaagatttttttgttccaccaatggaacttcaattaaaatttgaagaaattgcaagacctattgagcataaaattgcaaaattgaaagaagaaaatgaggtgttggcagagattagagataccttactccctaaattgatgagtggagaaatgcctgtggaagtgggtgaaaattaatggatgaacgtgaacgatacgaagaatatctacaagatgagttagatgaacaattttcaatatatagcgtttctcacttactatcaaaactgtctgactatagccgtatcatttctgaaaatgaaataactggtacattgctttttcgtggacaatctgacattgaattcggcatagatggaagcatttttagaaatggactattagcaaaagaaactactatcgttaatgagctaatattgcaagaaccactggaatttggaaatcatatgactgattttgaacagttggtcaaaatgcaacattacggtttgccgactcgattgctggatattacaaccaatcctttaatcgctctctattttgcttgttctgaacatgaggacaaagatggtgaactgattttgtttatcgaatcgctacagcgtccgacacaaaaagaagtgaaattgttttctgcacttgcagaatatgatggaaaaagcgaaggaaattttttggattacttttcaagaaaaggtctcggggatgatattttatcgagctttgaagagaaagtggagcgactgaagacgcagtttcaaaataaatatgtccctgtggtagctcctaagaacaatgaacgtataagacgccaaaatggtgcgtttttaatcttaggaatagacatatctgctcctgattattatctaaaaaacagtttcaatttaaaagatagtctcagtgaatatgtagatgaagggattccaagatatttacggatcccagcagaacagaaatcttctatactgcatgaacttgatatgattggaataaatgaagcattcgtctacccagaattagagcatcagacatcgtatatcaaaaaaagacattttgtaaaggcaggtgaataaaatgtccaaatttatagaaaatgatcttgaacaagcagcaatggagtggtttcaagatttaggctatcaaactcaatatggaccagacatttcgccgggaggaagcttttcagagagagaaagttttggagatgttgttctgtacgacaggttacatagtgcattaaaacgtattaacaaacaatattccaatgatacgatttcagaactggttaaaaagattactcgtcagcagagcttatctattgtccaaaataatattgcgtttcaaaaattattaaccgatggtattgatgtagaggttaagcagaaggacggaagcataaaaaccgaaaaagcttatatttttgatgccaaagatattgaaaataatgagttcttagcaatcaatcaatacactgtaattgaaaatggaaaagaacgcagacctgatattgttgcattcttaaatggtattcctgttgttgtaatagaactgaaaaatgcgacaaacgaagaagtagatattgttgatgggtttaatcagcttcagacttataaaagagatattccttctttgttttattacaatgcctttatgatcacaagtgatggtatcaatgcaaaagttggtacaattacttctgatttggatcgatttatgttctggagaacaattgacggagaaaaagaatcgggactttcttttccgcaattgcaagttatgctgtatggaatgatgaataaaaagagatttttggacattgtttcaaagtatagcttctttgttcacgaggaagataagtctttcaaaattttgcctggttatcatcaattttttgctgtaaataaagcattgtataccactcacttggcagcttctgaaaatggaagcagaaaagcgggtgtaatttggcatacacagggtagcggaaaaagttattctatgctcatgtatactcgtcaattggttttagaattgaataacccgacaattgttgttattactgacagaaatgacttggatgatcagctatttactactttttcaaaaagtgccgattatttgcgtcaaacgcccaaacaggcagacacaagaaagaaattacgagaactattgagcgttcaagctggcggcattgtatttacgacgatccaaaagttttctccagacgagagtgaccaatcgatggaagcattgactaccagacgaaatgtggtcgttatagcagatgaagcacatcgcagtcagtatgggttagaagcaaaagaaaaggatggaaaagtttcttttggttttgcgaaacatatgcgagacgcattgccgaatgcttcttttattggatttactggaattcctgttgagttgagcgataagaacacccctgctctgtttggtgattatattgatatttacgatttgacgcaagcggttaaagataaaactactgttccgatttattatgaaagcagaattgcaaagttagatcttccgcaggaattaaagccaaagattgatgatgagtatgacagcattgttgagggacaggaggaaacttacgccgaaagccaaaagcgtaaatgggcaaggttagaagctattgttggaacagatagtcgtgttgatgtagtggtgaaggatttcattgctcattacgaccttagacaacaggcgattaatggtaaagttatgtttgtagctatgtccagaaagattgcagtaaaactttactcaaagattatagaataccgcccggaatggcatagtgacgacattgataaaggtacaattaaggttattatgacttccgcagcatctgatccgcctgaatttcagccgcattcaactactgcatctcagaaaaagctacttgcaaagagaatgaaagatgttgaagatgaattaaaaattgttattgtttgtgatatgtggttgacgggatttgatgtaccttgtcttcacacaatgtatgtcgataaaccaatgagtggtcataatcttatgcaagccatagcccgagttaatcgtgtgtttaaggacaagcccggcggtttaattgtagactatattggtattgcagataatttaagaagtgcattagcgcaatatacgccgtcggatagaaagacaacaggtattgatccacaagtggcaatagaccttatgcttgagaagtatgagcaaattcaaggaatattgcatggattggactactcttcttacataagcggctctgcaagtgaacgaatggcatgtattgtttctggtgttgattttgttttgggtaaaccggaagatgagaaaaaagaatttcttaatttggttgtagaaatcggtaaggcatacgcattatgctcgacctctgaacaagctcaagcaatcaatgtagagattagttattttaaagccgtcaaatcaggtattataaaaatactaccaaaggacaaacagaagaaaacgaaagatcaaatagaatatgaaattggtcaattggtttccaaatcagttatttctgaagaagtcgttgacatatttgcttcagttggattgaataaaccggatatttcaattttatctgatgaatttcttgaagaggtaaaaggactcccacagaaaaatttagctctggaacttttacgacgtttgcttgatggtaagattaaggcgatagctaaaaagaatgttgtacaagcaaagaaattttctgaaatgcttgaagcctcagtaattcaatacgaaaaacgttctttagagacggtagaggttataaaggctctggttgatatggcaaaagatatgaatgagcttcataaaagaggagaaaagctggggttatcagacgatgaactggcattttatgatgcaatttcgtccaatgaatctgccagagatttctatgaaaatgatgttctaaaacaaattgctaaagaactaacaatcagcattaaaaataatattaaagttgattgggatgtgcgagaaagtgttagggcacagatgagaattactgtaaaaaggttgctcagaaaatataaatatccaccggataaacaggcaacagcggtggatttgataatagagcaagctgaaaaaatgtgtgaaaatgaaatttattaaaaatagtcagctccattgagcggactatttttaataaatcaactctgcatttacaatttctcttgctctgtagcaaacattgttcatttgcgcaacccattccgtctgatcttttgccttaagttcttctgttatgccttcgctttttgcaagttgctttacgatttgaagaaacatattttcagcctgattttcaatatcgacaagatagtcgtttagtttcccgcttgtcaacaggttcatataaataattttatggtgctgttttaaatatcttacgtgtcgctgcccccatactccgatcggctgaccttgttgttctggcaaacggagatttggtatcaggtaatccccaacttgcgtataagtaccgcccatttgttcaaataatgacttttccatagtattttcctcctgtgttttagtgtacttttattttacagaaagatgggtaatgaaaccaatgtgccgataaaaaatacagcgtacctgctatatcacagatacgctgtattttcatatgtttatttcgagatatgtatttaccaattgctgatacatttttcttgacggctgtcgtgaaccgccctcccatttagaatagatgctcaaactaatacctgctttttcagcaaaagttgcttgatttaatctgtgtgcttttctgacttcacgaagtctatcactgtaaggataatccataaattgagcaaactcatcgaagagcagatttctatcaatttcaaggacttcagccatagcaacggctgtttgatatggtatcgggaatcgttcacgctcatacattaacactgttgcgggtacaactcctatactttcggctaactgccgtgtggttagaccctttcgctgccggtagtattttagcattgccgcaggagtttgttctgtaggaaaaccttcaaaacaaaagtttaaatgtattaatatctttccgtgcttgtattcatataagtctgtgtgattgagaatagtgtcgtattatcaatcagatttcccaggatcgttgtcaattcaaaaagattcagaaaatccagcgtatttttaaaaccacacgttaaatcaatatttagtgattttattttttctacttttgaatttatcagataattcaaatacatatttgatgttgaaagaacatctataatttccatcttacctataatatcctgcaaacattttaatgccagctcatcatcaaccttaatcgttgattctagcataatgaaatgattttttaactttcaaattctaacacaatgattacctctctggcatacctgctctcttcatatcctttaagaaccaccccagcaatacgatacctttcccgatcgaactaatcgtaattgcccaccagacgccattcagacccagccatcttcccagcaatatcgccatcggtattcgtgcgccggttaacgtgatacttacaatggatggaggcagcgtttttccaagtccgctgaaggcacccgctgttgtgatttccatacacataaacaactgagagacaccaagaatccgaagataatccacccccattggcaacacctctgcttcctggataaagacctgaaagatgagctgtggaaaaacgatcagaacaaaagaacagaacacaccccaggacagcataacaatcatggagagtcgatatccctcccggattctatctgtattcttcgcaccatggttctgagccacaaagctgttcaaagccgccgcatagccttccgcagtcatccaggaaatggattcgatttgtgaacccaccttttgtactgccacggcagcgtctccccagcctgcaatcaatcttgcaatgaccatagaaataccggaaaataacatactctgcacagcggagggtaatccaatacggaaaatttctcttgtatgctgtgaagaataagaatgcagtatatggacatcacagaacaagaccgtatcccgtagtatggtatacagaaacaacagcataaccaccagctgtgcaagtactgtcgcaattgcagcccccgcaacacccatcggatgaattacaccgaaaccgaaaataaacagaggatccagcacgatattcaaaacaagcccaataccggttgcgataaaggaggttctgctgtttcccatcgctgtcagaatcccggtgaatatctgattcataaaagaaaatatgaccagaccgcaggttatcatcagatacagctttgcatcctgtatgacctgtgcgctgttcagctgaaaaaagccgatcatctcgtccgcaaacacaacagacagaataccgaagccgatggcgaatacaattcccatctgaatcgagctctgtgcataggatgtcgcatcctccttcttctgcgcccccagcgcatgcccaaccttgatctgacctcccatctttgccaaggttgccaaaccattggacagccacataaacataccggctgcgccaacggacgcgacagcacttgccccgatttttccaatccatatcatgtcgatcagattataggccatctgaatcagactggttgccatgattggcaatgccagcgcgcttaatgcgggaagaatttttccctccagcaaattgatacgtgttttcatacgtcaccctctttcaaaagaaaggcttcagaccaatccagtctgaaaccactgatttattgtggataaacgagctgttcctcgttccagtccttcatcacctgaccataagcctttgcataggatttcgccttggcaagatcatgatccagataattgccgcattccttagactcctgtgcacctgggatatctccctcaaatcccgcaataaacgccatcgtatccttaaccagctgcaccgcctgtgccttactgatagaatctctcgttagaaaatagaagcctgttctgcagcccatcggcccggcataaatcaccgcattactgtataccgaatttcttacataggtagcgaacagatgctcaaaggtatgaagaccatcattatccagatacgtaccgcagttcggcttcaccattctaaggtcataggtaataatatctccatcgattcttgatatatacattcctttatccaggatgtcatgatcaatacaaaagctagtaattttttccatcttatattcacctctatgtaccattataaagggataaaacaagactgtccagctgattcctttgcagaaacggcaacagccagttatttctttctctgttaagcgttttgcgtagtcatgcgctgtcagattttataatatattcttctctattcacatctggtttaaaagcattcggtaacttccttcctgaaaaagcatatatattttctgttttcacgttataatacatatagaatatgattagcgcctattaggaaaacacactgtcaaaggggtttgtagcgggggttagcccgctactgcggtatcttccgtagtgttaatttcaatgtactcggcaatcttgcggagctcgtcagcaaatttgaatttcacgctgatattgccgttttcatagaccttgatatagtccacaagttcaaccaagatttcacggttgagggcttcaatgttctgatacttcataaaggctaccagtgcaggatgctcgttgtccacaccgtttgccagttctgcgcgttcagcgttcagccgggtaagcaccgcggaaatattagaagtctgccgttcatagtcagccttcatatcccggtattcctgctgggtgatttcaccgtctttccagtcctgataaagagattgcttgtagcgtgttatctttgtcagttcccgctcttttgcagctatcagatcgtccagtcggtaagactggctttttttgattggagcggaattgatctgcgtgacgatttccgagtaggaaacagccaaatgtacctgatgctgtacagcgaacaaaacagcagcctccagccgttcatgcttgattgagtgcatggtgcaggctgtccgggaacggttcttgtaggttgagcaagaataatatacattgttgttcttgccaacgcatcgggtaatggcccgcccgcaatcggcacatttcagaaagccgctgaataaatgtacctcacggcctttcggggaagtacgggtatcacgctgtaagagagcctgtaccttgtcgaaagtttcatagtcgataatggcctcatgcgttccagccacttccacccattcctcgcgtggaacagcttcaatctggtgtaccttgtagcttttcacccggcttcggccttgggctaaatccccggtgtaggtcggattggtaagaatggagtggatcatgcggactccccacataggatcgtcataccctcttgtcgaaacaggcaagcccttttgtaccttgtaagccgaggggctcggtacgccgtgttcgttcaggtacagcgcgatagcacgttttgatgacccttgaataagcattgtgaaaatgagtttgacattttcagcagcatcgggatcaacaatcagcctgtgcttgtcctttgggtgctttacatagccgtaaggagcaaatgctccgatatactggccgttgcgccgtttgtaatcaaatacctgccggatctttttggaagtctgatagcagtaattatcgttcatcacgtttgtaatgggaacgatgatatttgaaacgctgtcggggttcttgtagctgtccacattctcagcaaggctgataaagcgaacacccatttgaacaaacaggttatcgatcaaacttccggcatcgctataatttcgtgcgaagcgggacaggtcttttactataacgcagttgattttaccactcatgacatccgccaagagccgttgaaaatcttcacggttggcgtccgttccagtatgaccatcatccacatattccgtgatactttcaaactcgtcaatgttgcgtcggtaaaaatcgttcagtaggtcacgctggttctttacgctgttgctatcgtcttttccttttttcaaatcttcctttgaaagccggatatagatgcccagccgccagcgacggattgtgtaagagggagagaaactctgctgataccctctgttttttgctcgtgccattgttcctccttccctatcacattacacttatattataactctgtccggggaggacaacaaggatgcctccacttcgggacactttgtctcgaagaagcaaaacgagctgtaaccgaagttacagcccgcttctttgccgcagcaggaaatccgtcagcttatcttggagagatggcccgctttcagcaaattcaattttcacgccaacaccaccgatgcaaaagcagtatggatttttgacagtctgcaaaaatcgagagatgcgctcctttcgggaaagcgcattgtcaaaggtcataccgctcacatcaggcagggactcggcagccaccgcgccaatgtcaacgcttctcatttgttcaagttcctgtgtagttaatttcacggtaaacctccttcgcagattgatagaacgccccccgctgtttggtggggaaacgcaacagaccagcaccaccgggatgctggcctgttgccttactccaccttgggacactttgtctcgaggtttattatagtttttgaatattagagagcgccgcacatatttacttggcctgtccaaagacaatcgttatttcctgtgcggcgctctcaacgcaagtaaagcgacaagcccggaggaacaggcagccaacctgttcagcaccggatcatggccttgggatggccgggcccatttacagtgttggtgttgttcgctcaatctcttttgggaaatgtcaccgcgcacccaccgtctggctccacgtacttactcagggttgccgttattcccttgcgttaggaagaaaacctcctctcataaaccgagacattttttcatcaattccaagtgggttaagaagaaaaaatcaaaaagtttttttcatgcgttcaaggccacgcttgatcgactggcgaatagactcctcatgtacgccctcggcctcggcaatttccttaatcgacttgccaagaatgatatgtgcgtcaattctgcggccctggatctccggcagagaattgagagcgttccacagacgaagaaaggtttccatccgttcaaggagctcctgcggggtcggctcatgcaggcaagcggaatattcaatcccgtcatcgcagtccagagaatactgcgccttgtgccgggagagccgccgctggtaggccatttcatagcgggcatcggccttgaatacctcggccacctcgtcagaaacttcgataagctgatcctgcgtgtaccaataataaaaatctttcaaattgatagtagtcatcgtaaaatcctccatttcagtttgttcggggttggtcggaaacgaaatggagtaacggcggagaacggcaccgcgcctcgggacactttgtctcgaagtctggaaagcaaaatgcgcctgtgcgacacaaggccgcacaagcgcacgaaaaagtattatcggttatgtactgtttaatttcatgttcaaagccggactgcttcgatggaggggctacgctttttttaattggtgcagatcatggatactgcgaaataaaaagaaggacacggaaaaataacctccaatcggctaccgtgtccctgcaagtcgtcattggtttgtgtaaacgcaaagaaacggcggctctgatttctcaaaaccgccgttagggtaatagcttaaaataggcgcgcaaaatcacctgccccaaccaacggtttttttctttccccgtagtcggggcaggttcatgcgctatgcaattattcttctttagcttctatcaagccgatattttttgctctgcgttccacatagctgcatattttccgcccttcgcaagcaattcttcgtgggttcctgattcagcaattctgccatcacccattacaaggatttgatctgcatttttgacaatggaaagggtatgagcaatcattaccactgtctttttttcttttagcagattggcgatggcctgctttacggcaagctcattttcaatatcaagagatgctgttgcttcatccaaaagtaggatggggctatttttcaggatagcgcgggctattgaaattcgctgacgctcaccgccagagagaagatttccattctcgccagtcggcgtatcgtatcccttttccatcttacggatgaagctgtcacagttagcctcccggcaggcagcctcgatttccgtgtccgtagcattagggcgagcgtggcggatattatcccggatggtatcatcaaaaagaaatacgtcctggtctaccatagaaacttgttccagtacacgctctgcggcaatatggttaatgggtttaccaccaatcgaaatcgtcccgctcgttgcttcataatattttgcaatcaggttcaaaatagtagatttgccggagccagagtccccgacaatggccgtgagcttttgatccggcaccgtaaaagtagcgtgtttcagtaccggctcactgggcacatacgaaaattctacattgtcaaaggtgatttcatgggtagctgtgtgaagcggctccatgctgccagtttcctccggctcattcattacacccccaattttgttttttgagatcatcaggttcttataactggtgagatctacaaaaatcgagttagccaactttgcacaaaacaggggtaacatacaaatcaaaaggtaatctactgtgttcagtgtccctgcgatccaaggtgcataggacaaccagataaccagcggacaggacagccaacttaaaatgccaaagcccgcaccaattggaagcacctttgcttcgtatacaaagctgatccggcaaaactcccgcatggcgttgataacggttttgttcttcataccgcctacaccataagctcggaaagtctgaataccagaaacatattcaacaatgctgctgacattctccgcacaaatatcgttcttttcttttccatatttccgtaccatgcggaaagaaagccacaggccggggattaaaagaaggtctgctatcagcaggataattccagccggaacataaagcgtcataacaaagacaatcaacatcaatgacagggcaaaattctttgccaaatctccgactttatgggtcaggattttttcgtagttgtttacatcgcttgtgatggtgttgatataatcgccggtctgcccctgtgtaaatcgggacagtgggatgcgcttcaaatggtcacccataaaaagccgaatattcttactgacctccgcaccgccaatctgcgctttggtataaccgtagctgtaaatcaggatacggagaagaaaaaccactgcaataataccggtcagagccagaacgcggttcatgtcaaattgacccgaccacaaaaactgcataacagagtaaagcagcataaacaggctgccggagagaagtccttccagaacggttccgccgacaccaatatagaaattgcggttttttttcaatacatcatgctcattcatgctgctcgcctccctccaactgataagtgatattccgggctgtctcgtagtctttccacgcatttcgatagtaggcgttgttcttccgaacttcctcatgggtgccaacgctggtaattgtatgattttccaccacagccacccggttgcacattttcaaagcactcaaacggtgtgctactacaatgactgttttgcctttgcatagattttgaatagctttatcaatctccatctgattttccgggtcagaggcacttgtggcctcgtccaaaattaagataggtgcatttttcagaattgcgcgggcaatcgcaatccgctgtttttcaccgccggagaagcgagagccaaagctacccactttcgtgtcatatccatctggcaaggacatgataaaatcgtcaatctgcgcctcttttgcagcagcccgcacttcttccagagtggcgttgctgcccattcggatattttctaaaacgctgtcacgggtcaggaatgtcttttgaaatacgatggctacatttttcagaatggtatcgtagtcaagctctttgacattttttccaccaatcagcacttcgccctcctgcacatcatagaagcgggagatcagttcaatcacagtgcttttaccggcaccagactgtcccacaagagccatgcgttccccgtcattgattttgaggttgacgccttgcagtacatcggtcttgccgtcataggaaaatcggacattgcgaagttcaatatcgtgattttggggaaagtccgttccaccctcataaatcggaatatccaggatttctttggtcttggtaacagcgttcagtacattagcaaaattagtccccagttcttgcagggggcggatttccgtcagatacatggaacctacatagacgaacagcaaaaatgcgctggccgccagtgagcctttgaggaaaaacattccgccgattggaaccatcagcaacatcccacattcgatgataacaacaaaggccgcataaggtggccccatgcgccgggaagtttcattccacatggcgttttcttcctggatagcgtctgaaaacttttgaaacgatttgctccccatgttataggctttaatcaatttcataccgctgatgtactcaatcataaccgagttcagtgtggtaatggagcgattggcccgttccatcaggtcatccgtgttgcggaacatcatccccattacaacaacagcaaggatcagcggaaccagggaaatcaatgccagaggaatattgacggtcatcaggtaaataaagatgactaccggcccaaccagatagcacacaaggtcaggaaggttatgggccaggaacaactccagcttttcaatatcttcattcagaaccgtttttatatccccggtgcgccgttcattcaaggcccccaaaggcgctctggccatgtgttccgcaaccatgcagcgcactttgaacagtgcgccgtatgcgcctttatgggctgccacgccggaacagccgaataatgcaaaacgcagggtaacagcggcggcaatcattgccacagtctgtaccacaagttcttttgtgcaggcattgttaaatgtggcatccatcagcctgtaaatcccaatatacggaacaataatgcaaagcccactgcacatggacagcaggattgccaggaacagccagattttctggcctccggcccaatggagcagcagtgctactctgttttcttttttctgcttcatagactacctctcctttccatctgaaacagagaacagctctctcaatttcgggagggcatccattgtaactggtacatcatcgggcatttctccctcgtcaaaatgcaggacacgtgagcaggtacggcagacaaattcaaaatcgtgggtgacaatgaaaatgacttttcccatattggataatcgccggatcaatcctgcaacctgcgtcatactgtcaaagtcaaggccgctggtcggttcatcaaatacaagcaagtctttcccacaaaccatgctgacagctacagctactcgttgcttttgaccgccggaaagcgtgtttggatgttgttctcgatatggggaaagtcccagttcttccaaagttgcatttaccagcgtttggtctggatttcggatgccaaaggaacattctgcttctacgctgtcagcgaaaagctcatagttcacatcctgcatgaccatataagagcgttgcagcctttccttacgctcaatcggcttgctttcccacaaaaattgtccatcgcagtctttgtgaagcccacagagagcgcgagaaaatgtagtctttccggctccattgtggccgaccacgccaatcacttcaccctttcctgcggataagccaatatcatgcaaaatggttcgcttcttgtaacggagcgtcacattccgtagctctaataccgggataggggcaatcgagtggggtttaggtgggaacaccgcccgaagatcaactgcccgcaggcccatgcgttcacgctcctgttccgacagctgtcgaaattcttccggggtataaatccctttgatttctcctttttccagataaacaattcggtcggccagttccatcaggtagtacagccggtgttctgctatcaaaaccgttttgccctgcttttttatcagccgcaaatgctctctcaactcctgaatggaagtcatatccaaattggaggacggttcatccagcaaataaatctgtgggttcatggcataaacagaagcgaaggcgattttctgcttttcaccgccggacaactcaaaaatattccggttccgcagcttttgaatacgcagatcgtcggctgtctgttccactcgctctatcagctcttgtggaggacgagcctcgttctcaatgccaaaggcgatctcgctgtctgtgtccacattgaaaaactgtgtccgtggattttggaaaacggagccgaccttagcggcaatctgatacatagggatattgctgatttcctgaccatctaccagcacacggccatgaagttccccttgataaaattgaggaattaagccgttcaccagccgtgtgatcgttgtctttccgcacccactgcggccacagaacaggacacattctccgtccgaaattttcaaattgatgtcatgcagcccgccatgttcctgtcctgtataggaaaacgatacattttcaaactcaatcaaccgatcacacctccccgcacacataattcaaaaatcagataagctacggcaacggccataacaccccaatcggcaactccgcattttatctggacaagacaggtgcgtggattgggattttcaattccacgagtgacagaagcaacagaaagatcatccgctgcttttgaagctgccatcaacaaaggcacataaatacactcaaccgtcatgcccggatgtgctaaaaagcccgccagagaaggtgaaacatctctcatccgcatagcgtccttgatatatcgccagtcctcttgaatagttggaatgtaccgcagcataactgccataggaattactaactttttgggtgcgtggacacggttcatagcagacaggaactcattgacttttgtagtagtcagaacaatcccagccaaggttccgcacgcatagaccttatgaaacaatcctaaaaaggcaataaacattgtccgcagcgtgcctgtcatttctgccatgatccaaactgtcaggacacagatgaccgcataaaagcatacagccttaatgacatatttccactttccaaagaaagcacccaatatcgcaatcagcataacaaggacaaattgatatgcaagtgaaggagcgaacatggacgataaaacacatataagaataagaaagagcttggcccgtgggtcgagccaaagccctttcttgtggcgtttaccgctcattctgtaatacctgctttttcaaactgctttttcagcattttgcagcctacaaaagcgctgattgcagatgtaatgataacagcagcgaacatggcaatcaggatgccggtatttgcagttgcctgcatggtgtcgatgtagctctgttcggttccattacccagcatggtctgcgcccagccgttgggatcaacaaagaacacgatatatgaaccagtgccaccgagagagaacaggatataagacaagctgttgagttttttgcttttgtactgccctgcaccagcaacaaagtccgcgacaatcgccatgatcagatagcccaatgcaaaagcccagtgcataccggtcacgaaccaaataatacccatgataacgcccattatagaaaggctccaacgcttatgtacttttgcaatcagcaaaagataaatggggccagcaagcagcccacctcctgccggcatgaaaaaagtaagtacaggattcgttgcaaaaaagacaccgcccaccaatacaaaaacaaataacagtgcagtaaaaatacctgttgttacaaggtctttcactgtcagacctttgttcatagaatttacttgattactcattttgacctcctacctttcattgtcttgactcgacaagtggtttgtgatattcttcggttagatagttctaaccactgtctaatacaatacgcatttatcgaacaacattcaataggccccggcgatgttcgtctgttcctttcaaaagttcgtctaatcgttgcaaaaaggaggcagtctgttttcatgtctgaaattattgaccagttttatacaccgttgctgattgaacacggttttatccatgacccagacaaccagcaatatggggcattaggtgactgctggaaactttctcccgaagttggagaaggctcctactggacttatggacagaaagacctatatgatattaaaatccacaacttttccttccacgaagatttcatgttggaatgttccctgccggaatgtctgagtatcactcggtatgactctatttccggggaggaattatctccataccgtaggctgtctgccggttgtatcaaaacatttattggaggctacgctccatacaaggctttgatacataaaaatattccaatccgttcggttgggattgagattgcaccggcatattatgaggactacctgaaaaaactgtacccagaggcacagatcaatcctgtggatgcgtttcggaagatcgaccaaacttccgactttccagaaatgtcacggttactcacagaaatcaaagactatcgcggggaagggattgccgcaaaacttttttatgagggtaaagtcgcagaagctgtttcaatggtggtggaatatcagaagaagcatcctgataaaccagcccataagctctctcaacaggatattgaaaatctccaaatagttgccgcttatcttagcgatcactatgcttttgatattcctctggaacggctaacacagattgcctgcatgggaacaacaaagctcaaaagctgttttaagaaatactacgactgcaccatcacggaatatgttcaacagcggcgcatgagccaagcagaatatctgctggcatatacagagctgacagtcggacaagttgcccaaacagtaggctattccacttcaagccgatttgcagaattattccgaaaaagcacgggattgttgccattagagtacagaaaaaacgcacagcgaaaataaaatgagcgccagagggaactctggcgctcgtcttattttatgttgaattataaaatgtggtgaaattaaatagtcagtagtatgaaatatacagtcgttcaaataatatcacatgaaatgtaaaatcatatcaggtgatgttatgaagatagaacgagatgaaagacgctttgattttcacgatatagggcttgccatcaagcgggcaagagaagccagcggcatgacgcaggagcaactggcctatattgtcgaccgcgctccgcgtaccattatgtataacgaaaatgacggtcagcatccaagcttcaacaccttttatcagatggtcacaatgtttgatatatcggtggatcaatacttttacccgtcccagaatagcgggagcgagtgcaggaagcggattgatgccatgttgaacgccttggacgaaagagaattgaaaatcgttgaagctacaatccaagcgatgaaagcatcgaaagaaacggaggaaacgtaaaagaaagcgtaacctccgtttttttgcgccatgttgcgggttgcgcgttttggcaagcaattcgggtgtggccacactccgaaatttttgcagggcgcagggcccgcaaaaatgcttgttggggagctccccaaacccgctgtacttcgggacaaattgtcccaaagtcccggtgcgctgcaccgtagtctgcggcccgtcactatcgttcctgggccttattttcacgctcgtctgttatgccgagcagatgatcaatgttcgcttttattgccacgacctcccgcatttgccgctgggcatcccggtattctgcataaagctctttcttttgtcccgccagcttacggcgggatttttttagtgcttcaatcttggggagctttgcaccgttcagtatggtgttcatggtatcctttgccgcccggtaagtggcaagctccgcttcatgctgggccagatactttttactgtaccgcgcagccttgtacccatcgaacaccgggcgggtcttggcatagtccaccgtggcagccatcagctccgaggttttggaaagggcctcctccgttgtgcggagctcgtcagacagcttgtgaaagtgatccacagcagcctcggtgcgggccgtcagcgccgcatagtctgtcagatgatgctcctgcaaatactggagtgcagccgccatctgctttaagttgtagaccttggcccatcgttcataggccgagcctttgccctgggccatacgctcttgaatgtcgatgatgagattaactcgccgtggcggaaccgtgggctcctcgggtagctcggggagcggacgttccccggcaattaccgccttgatgtcctccgggtcaaatccggctcccagtgtagaagccctgagccgggtcggtttttcctgtccgggcgcaaggaatgagatgacaccgccgcgcccctgtttcaccgcaaagccaaactcatccatgagccgaagaaagtcggcaaagtctgtgggctttttctccaaaacggcgagaatcgccaaccgtacccgctgcttggcagagggcggcttttctccgatccactgaccatagtgaagaaaacggcccttgctgtgctggcgcggattttgaatgacagacagttcatgttcgatgcacacgcggtcagagagccgccgcaaagcaaaggatgatccgatgaaattatgaaatttccgggagcggtcaaaggccgttgcattgaaataaatgtgattgtgaatatgggccttgtcggtatgcgtacagacaaagaactgatactttccctttgtccagcgcattgccgtttcataaccgatacggtttgcttcttccgccgtaacctccccgggcaggaacgcctgccggatctgaaagaacagggccccgcgagatacggcccggcctgtctctgcaaggtattgactttttaccagaagaaactcggcgggagccgtgttcggatcgcagagataggaagatacggctcccaacttttccgggttcaggccataggtgaaacgctcctccatcgtttgaattgcactttttcccaccgctgttttataagggcggatgtaggtggtcgccgtagaaatccctccttccggcaaatagtatttttactttgggacactttgtcccgaagtagaaaaagccggggagcggtatcaaccactccccggacgggtcagagctctaccagcgcggagagctgtttcaagagatcagacagcggcccccacaaagcggcatagtcccgctgcaaggccgcgagttcttcgggataaattgcgccgtaggtgttggcttgaattgccacttggttcagattgttggagcatcgccgctggagcgaaaccaactcacgaacaggcgaaaggtcaacatgaagcacatacccactcagggccattttccgcatataggctcccatgttacggatgccagcctccgccatacgttcttgaatcagggcttgctccgcctccgacaccatcacatgaagatggatcggacggcggcgcttttttgtcatcgctcctcacgctcccggctacggcaggcgcggggcagctcctttaccttatccagcggcttttcctgtttgtctgccggaacagggcgcggcaaatgaaattcacggtgcaggcgcagcacctccagtacagacaattcctgttcacgtttcttttccatacacacttcctccttatcgatcgccacggtcgggctgcctgcgctggggagctggagcctccgagccgcgatctgcctccgccaactttgccgcgtttttcatctgctcggcaatcggacggggcctgtcgggattatcaggcgcaggacgcagctcatagtcggatgcctgtttttccgttagcgggcgggtataggtaagatagccccaagccaagaacgagccattttccaccgggatgcgctgatcgtaattgaagatttcatccggcttgttataaggcggcttcgggaatgtcccgatgtccacaggccgctgggtcgaataatacttgtaaaggccgggagcctcggtctgcctgatcccgacgttataaatacgctgatagtcctgcacccggtctgtgaaatcctgttccatcgcggtgcggtcatttccatagtgaccccattcatactgccgctggccgtccttgtcatcatagcaggcccatgtgacatagcgggatggcgcggtgggatgttcgcccaatgcaaatcctcgtccattttccagcatgaccgccttcaaaatggcgtagccttgatttttgtccatagtacacctcccatcatcgagacatttctttgttttctcttttcacaaacggctggagctgataggggcttgtaccgtcctcgggccgcagaaagtctatccgggccgcagcacggatggcgttctggttaagctgccgctgccatgccccttggctgggagcccacttaaagccgttgcttttcagttcctgccgctgattggcatcgggcttttcctcaaaaataagctgcaaacgattttcagcctcgttgatttttgcctcgcctccggggaatgtccagcctgcaaactcggagcggctgctcagttcctcaatgcgctggcgcacacggcggatgttggcgttgttgttggaaagcagataggcggggtatggcttgcttttgtccaagtgccatgactgcgccatatctgctttgagcttttcggcctgctccggcgtaagctccgggcagccgtccagcgttttgtgtttccgaaaatacgcattgaccgccttcatggtggcctgcagggactccagcccctccaacttttttgtcagcttttccacggccagatcgtcatccgcgctgatcccacccattccaacagagcggattttatcaagcagctttgaaatctccgcatactctccatagttgcgatcccgggcggcgttctgcttgtgcttttttgtcacagggaaattgccgcccccggagatcagaatagagggcacccgggcatcaatcacattgcgttcattcagattttccgcaagtttccgggcatagcgatccaccagagcgtcaatcttatcgtggtacatgggatcgacacggactttctggcgttccgccgctgcatacgcttcatcgaccattgcccggtagctcgccgtagcggagcccggctgatagtcggaaaagctgttcatatcctttgcccgctttgcggtttcttcattgatcggataatatttcggcatagtacctccttccacaaaagccggaactttgggacaaattgtcccaaagccccggcagctaaaatgttgacagcatctcacggaaacagggccggacgtagaaatatacgcctcccgcagaaaagggccttaaaaagccttgtcacaggcgggttttggatgtcctaattgtcaacacatcagccccgttttttccgcatatattcccgctgctgtctgcggtgtgccgcctttgcacaggccgccgaacaataggtttgccgtccatcaggagccacggctctgccgcataccgggcaagccttgaaatccggccttggcccttctgccagcagcgcagcctccagcgccggatcaaggggcagaacagcctcgcggaagtagcggcaataagcccccgtccagcatttcccaaacatatagcactcgcaatccagcggcaggcagccgcagtcccggtcatagttggcacaccattttgataccagcctgcggattgccgctttttctgtccgggtcagttctcggcccacagcatcacctcccgttgcccggtggtttgagctgctcccggtagcagaacacgcagccgatcccgcgccagtaagggcagccatcacagcgggagcccttcggcggcaggctgggcggcacacccttgaagtagcttttttctttcataaatccctcataggggttatttgtaaatctcattcattatcctcgctttcggtatcgtcctcgtcccaaggcggcccatcgtcctcgggatcgtcataatcggccagttcctcgctgtaatcctcctcgggtacagcagctttttcatgcttcgggcggtagattttgaagtaccagcctgcaccgctgcccagaacagccactgccaaaatcagcagaagtgtcccggtattgcttttttgctggggttcgggttccggctcctccacaggttccgtcaccggggcgggttcgggagctgtgccagcacactcggtcatgttgaccgcgcagacctcgcaatccgtatggatggctccgggtgcacatttttctgtgcaggagcaggccggaagttctccgccagcggcctccagtgccgccagcagatcggcttcatccaccatgttcaaaaagtaggtgtgatactgttcgccgtcctcgtccacaggcttgtcatagtcaatgacaatgtaaaaggtgttgccgccgctggtttccaccgtgatgaactgtttgttggttgcggcatcgtagagcagatcgcgggtcacaaggtttccatcctccgaaaagccatcgcccggggtaatggtaggcgcaggttccggggccggagtttcttccacaacaggcggttcctcatttccgctgtccgaataggcgtaggccggaatcgcaaagccgcataaaagaacagcggagcaaagccccgccgccaacatacgaaagtgtttcatattcagttttcctccttcttttctttttcggacttcgggacactttggcccaaagaaccgccgtccttcagcttttcaaacagcagcgggagctccgtaagggaaatgctcatgccgcgcacaatgtccacgatctcgctgttttctgcctccagctttttctgctccagctccttgagccgggcctgctgttcactgattttggccttgaccttatcaatctcggcctgaattttcatgcttttggtagttgccatttcaaaacctcctgtcacggtaaacgcccgtaggcgtaaaaatgagattgccagtagcttgtattcaaatttgcgtagccgatgggatctccgcaatgcagcatttttccgtcaccgacataaatcccgcaatggctcacgcccggcgtgtcataggtgcctttgaagaacaccagatcaccgggtttgggagagctggtcggcgtacagatgttatagagcccctgggctcccagcctgcccacattccagccggagtgattgatgacccacgaaacgtagcccgagcaatcaaaggaagtggcaggagaactgccgccccacacatagggatagccgatgtatttctgcgcttcagcaagcattgcagcaaaggtttcatcgtccagatattctccgggcacttcgtagtcaccgggtttcccggtaatgtacttgttcacatagggggaatccgggaacagatcggggcggtttcccagcgttgccatatagatggcataccgggaaagctgatcctcgcccatgacatacacgggtacatgggataaatcaaagttctccagcgtgaccgtacagatgtaatagtcgtaaggcacctgataggtgtctgtatgggagttgccgtcctcgtccgtccatgtgtcggtttctgtgcgataccgggtttccaccaccacatcctcggtcaaaatgtactggcggtcaaacagcatttgcagcgttccctgtacctcgtctattgtccattgtccctcatggagcgcacacaaaagagaaagcagcacataggggtcatgttcgatttcgtccagctcgaagtggtattcgtcatagtcatgggtgctttcataggtgtccagataatgctgcaaatcatcttccagcgcacagtaggcagcttcggcggccagcatatcccgatcctcacaaggataggtgctggcccctaatgcaccagccccggcgttccccagcataagcatggtagaggaacaggactgcatagcaaacaggagcaacacacagagcaccgcgaccacggcacctgcgggatgacttttgacaaattccactgcccgggcagtcaggcgttctgtggctgtggcagttttcccagccgcagccgcgctctgctttgcagcctcctttgcctgcttgcggtattgtctgcggagccgttgtttctgccagtagcgggtaagcacatttttcgtcagctccgggtgctcctgtgcggcggtgtgaaaatgatagtccgccgtgtatttggtgtagcgagcctcggccttgcgtaccacttttgccggatgttcccggactttacggcgcacaaagcgagagccatgccgcagcgcggtttctcccacaagctcagaacgatgtgcgccttccgtgccgacattttcctgttccacttcaaaaatcttgccatgcacgaagctgtgaacggaaccgctggcaacacggcctatgcgttttaccgggccgggctttttcggcggcttttgcttcgccagcttctcccgggcctgttccagtttttcgcctttggactccatgtggagctttgccgccgcagcctgttcctgctggctttttttgcggaacttggacttcgggacagtttgtcccgaagtgccggaagcctccgacccgggctgctccccgtcaggggcgtgggcggtctgcgaccaagcctcctccttggccttattcgtttttcgtttcattcttcatatcctccgggcgggtagtcagcaggtcatagatttctccgcgagggaaccgatccacaaacgggatggtcacatttccatagaacaacaggccctcgccggaattgctgtgtgtgatataggaaagctggtgctcggaaataccgagctgttttgccagaatggtacggtcactctgcgcctgcgaaagcaggatcataaaatccgtgttatccagaatgttctcgatttcccggcttgccaaaaggtctttgacgttctgcgtcaaagcagacggcacacatccttttttacgcagcattttccagaccgctacaaagtagctggccgtcagtggatcgcggagcagaatatgaaactcgtcaaagtagcaccaagtcgccgcaccctcgtggaagttctgatccaccgcctgcgaaacaaactcatttgtgatgtgcattgcaatctttctaaggttttcgcccatgtttttcagaacgatgcacaccacacggctgtccgtcttgacgttggtaggatggttaaagagattgagggagcctgtgcaataaagctctaaggcagttgccacgcgccgggcttcgggctccggctggcgtaagagctcttcgtacaaatcctgcaacaacggtgtttttgcggtttccagtccgagcgcctgctcccgatacaccaaacgcacacagcggtcaatgaccgtcttttcaatgggctgcaaaccttccttgccgccgaccaccagctcgcatagggacaaaagaaaatccgccttcatggaaagcgggctttctccggcagccatattgagctccatatccatcggattgagatggtgcgggctgtccggggcaatctcgatcacctggccgcccagccttcgcaccagcggcgcatattcgcccatcgggtcaaccacgatgatccgatcctgcgggatggtaagaaatacattcaaaagctcacgctttgcggcaaaactcttgccggaacccgtagagcccaaatacatcccgtttgccgatttcagctttttgcggtcagccatgatgacattgtgggaaagtgcgttcatgccatagtagagggcctgcccagccatgcggagctcccttgtcataaaggggataaagatggcggtggagctggttgtcataccgcgctggatttcgacctcgttgtagccaagggccagcgaggaaacaaagccctgttcctgttgccagtccagacggcgcagagcgcagttgtatttctgtgcgatgccgcccacggtaaacacatcgttttccagccgctggcgggtaggagcaaggtttaccaccgtaaaggtcagcagaaacattcgctcattgcgggattgcagatcagccagaagctccgccgcgtccttgctgaatgtaatcaggtcagggggaagaatatccgggtcatagccggagcgcacagcctttctctgttcctccactttcatttttccgatgtccgagattttccccttgatggtcttaattgccttgagctgatccacggtctgaatgtgcatggtcacggtcatttccgcatccagctccaagatttccgccagcagcttatccgaaagctccgatgccataatctgcaagtaggacaccgcgccccaatactggccgatacggaatgtgcgggactggcggaagtcgagactgtccggggcaataaagtcttttgtgccaagcccggtctgtgggatgtctttccacgaaaagcggaacgcctcgcggctccccggatgcatctggctatgaagcagcgcaaggcgggcccgcccgtccataggctccgagggaacgcccagccgcttaaagtttcccatgacatcagcctccacacgctccagacggggccgagcctccgcaatcccctcggcgggtatgccaaaggtgatgtattttgagcgttcaatgccgttattgcttttggcaatctgatttttcagcatcccggtaaactcgtccctgacgctgttatagttgtcatccgctttcgggatattgacttgatagcggctgcgggaatgggaacggcggttgataaaggaaagctggaacggcagcgaactgtcaaagtagttgaggaatgagctccatccgctgaatatggcagtctgatcctcggtggatgccacggagtaattgatgtcctcatattccacggtttttgtatagagcccgcccgggagcttgcacacaccgtccgggtgcatggacagatacgggattgtctgctgggcagacagggccgcccggcctttacccttggcggctccgtttttcttctttgtgtttttcaatcacatcctcctttccagcgcccggcccgacaaagggcgcataaatgttttcggttcggtaggccctgatccccggccttagaaacttggcccggatgatattccgcaccaccttttcaaagggtaagccgtccttttcatacatggccagcaggaacgccgggagcataattcccagcatgagaaacatcgccccggtattgccgagggtgccacgggtcagcagataggccggaatccccaccgcgcccgcactgccgaagcagacaagctggcgtttggtgaggttgaaagctatctttgttttgattttggataaatcgtttggtacgtttacatagggcatagatcacactcctttctgcacttcgggacaatgtgtcccaaagtccgggatggttggtgttacttcatttccccacacagcccaaccgggcggggtctgcctggcaaagagctccacgcggggcagatctcccatcagggaaagaattttgtcgcgggcctcgtccggctttttgctatgggcttcaatcggggaaatgatgaattgatgaatgttggcagcctgccgcttcgggtgtcccttggtagccagcaggcagatttccgcgttgccccttgtccagaagccaaggccgtaaaaccagctatccgctttcttgttctttttcagccagacgaaagcaacagatttataggtgaagccccaagcctcgatcagccggagcgcctccgggagctgcgggaaagtggcccataaaaagagtgcgctgtccggggctgcaagatcagccacaggcaacgcacataactcctcaatgctcatagtgggataatgattttccgccgcgccctgtactttcttagccgagtagcgccaagggggatcggcgtaaatgatagaatactgctggataattacactcctttctcgccagagctttttactgcctgcgccgcgcggatgcgctcactggcagcggcataaaaggctggggccgtttcaaagcatacaaagcggcgttctgtgttgatggctgcaatcgcggttgtgccggagccaacgcaaatgtccgcgaccagttctccgggacgggtgtaggtgcggatcaggtactcacaaagctccacaggcttctgtgtaggatggatgccgccggacaccgtaggcacaaatagtacatttccgggatagcggcggccatcgttggactcggagccctgccgttcaaatttcccatagttggagcttgtaccgcttcgggaatgaacacgggtataaggcttgccataagtaaactgcggattgtagaccggggacttctggtaaaacactaagatattctcggactttttcagtggagcccggtttgcattgagaaagcccgttccgcgctccttgtaccaaatccactcatagcggagcatggcgaggttggatgcgcccagcaccttgtcaaaggggcactgtgcgaaaaacagcactgcgccattcggtttgactgcccatttcaccgcctcccacagctccgggagcggcaggggcacatcccaataattccgggttgtgccgtagggcggatcagtcagcagcatatccacgctatgttttggcaaagaacgcaagccctcgatgccgtccatgagaaacaagccctccttcgggacacgttgtcccaaagtgcggctatcggtcattgcgggcctcctttgctttggcaggtgcaggccgggcggcattttcttttccagcttgtttcgcggcctcggccatctgctccttgatcggggcaggccgtaccgcctgggcccgtgcaacaagctgttccaccgccgcatgatacgccttcacaccagccgcgttaatccgctcctgtgtggcgtggtcaggaatccgaaccgtagcccggtatcccgtccggctggcaggatcgggtttagagggagctccgagaaaaattccgtttttcccgtccacaaccttaaaatcgtcgatgaccacaccgccaaaattgacgctggcgaagccgatcagtttaccctgcggctcaatcggacggacagataccgtgatcggaacaaccgcctcctgcaagacagcatctgtccgcatttttactgcctcatcaatgctaacgcccttgacttctgcaagctccgcgatgggagcatcaaacagccagcgccgctcctccgcagcaatctgctccggggtcagcaatacatcgtctttcttactcagataaaattcctcctttccgcttgccggagcaggctgggcggggtcgtccatcagctcttttttttgcaggacggcctccgtttccgccataaagcggtaagcgtccgcttcagtaaactcctccggcgtttttccattccataagcgcgttccatccgccccgtatcttctcggcataagcacctcctcctgttaatgagcgccaaagatacgctgggcaatgctcccggtcttaaagagcatgaagcaaagcagaaccgtgtagcccacagttccccaaatcgccccaatgggatcgccgcttgttgcgatgccttgaatgagcaccgcgtaaattgcaacacatacaagaatcagcagcccttgaaagcccacggcaaacagggacttgatgtagttctgtccggtgccgccaagctcccggttggaaagcgtagcaacggggatgggggccagactggtcagcagatagatttccagcatcctgccatacaccaaaacgaaaatgataattcccatcgccttcatcgtgaagccaatgagcgcagactgcagccacagccccaaaagtggccccaagtccatcgcctccagcgaggtttccagttcggcaagcatatccgccgaaacatcggtagagccttgaatcagcccgcctgcctgcgcgataacgctctgcgacacatcgaacacggccatgacgatattgaatgtatttgacaggatcaggattgcacaggccgttttgaacatccatttataaaggttcgcaacgtcaacctcgtgcatattgttcttttccaaaagcatctgtatgagctcataagtggcaacaaaggtcagcaccattccggcaatcggcaggatcaccgtttcggaaagctgtcggatcagggagaaaaccccggcgtgccacgccgccggggtagtccctacctgtgccgcaatctctccgacttgggtattgacggtatcaaaaagcccttcgaggtttcccataatcccgccaatcagaagctctttgagccagtttgtgagccagtcggtgagaaaatccataagcgcttaccttaaaacaggccagacaacagagggatcagtgtggtgccaatgacgatgatgccgccgcccgccatgagctgcttcatgccctgggacttggagcccgggttatccgagccgtagccctccagcagattaaccacgccccacacgccaaggccagcaccgagagcaataacgagggtctgtaaagtgtcgattgcagatgagaaaaatgccatataagcctccatttctccggaattttcccggtaacaaaaaagccgcccatacaggcggcaggttacaaacttcgggacactttgtctcgaagcgtttatgcaaaggcgtctggatcgtcgatgtcatcatagttgaggatgtcctcgtcctcttccgtgagtgcatcgtccggcacagccacctcatacatcgtacacgcctcgttcagcccgggccgcctgcggcggttaatgagcctgtcgaggtcaaaagcgtttttctgtttatcggcctccgccgtataacggtagttcggatgctgtttcagatcatacttgggagagaagaacgggggcaggccccgaagctgcaaaatacatttgtctcccggcatggttgcaagttcggctggggtcattagttcccggcccagccgctgggtattttgactgtagctttccgactggccacgggagcggctgtcggtctgcatactgattgtggcttttcccaaccagttctcggatatttccttgatggtgctggcttcgcggccaccaaggaacaccacgctgtccatgttgccgaggattgtctcggcgtgtttatcgtaaatggccttgcactgtgccaactgctgatacaacaggcacagactcacctcgcgggagcggataaccgcgaccagcttttcgagctggggcacctgtcccgtgttggctgcttcgtcccacagcacccgtacatggtgcggcaggcggccaccgtgaacattgtccgcccgttcacacaggaggttgaacatctgcgaaaatgcaagcgccactaaaaagttgtaggtctgcgtggtatcggaaatgatgaagaataccgccgttttccgatctccgatgcggtcaagctccaattcgtcataggccatgacttcacgaagctgcgggatgtcaaagggagccagccgcgcaccgcaggaaattaaaatgctttttgccgtcttgccgctggccaatttgtactttttatactgtttgaccgcgaagcaatccggcttacgcttttcgagcccggcaaacatatagtccaccgcgttcataaaatcctcgtcatcctccttgacctccatgccggaaatcatatccacaagggtattcatgttccgatcatcggcaggcccctcgaaaatgatgtaggcaatcagggcgcagtacaaaagcgtttccgatttcgtccagaatggatcgccttccttgccttcgccctttgtgttggaaatcagggcatccacgaatttcagaatatcggcctcattgcggatatacgccagcgggttatagtgcatggattttgaaaaatctatgctgttgaataccttgattttgtacccgcgtttttgcaggaaacccccgacctgtcccagcacaccgcctttgggatcgaccaccacataagaggaatgagcctgtaaaagctggggcgtgagccagaagcgggttttgccggagccggacgagccgataatgcagcaattcaagtttctggcatttgcggggattttcgggcgggtgttcatcgtgaggaactccgtcccggtcaaaatcacgttgttttcaaacttcggatcgacaaacggtttgatgtctttttccgttccccaccgggcgctgccgtattctgcatcccgccggaacttcttagcgttcttgcttttgaaatagatcagcagccggaaaccaacggctcctacaataccgataagccaatccagcggggcaagaccgggtgcaaagtcagcaaaggccgggccaatcgtctggcccagcccgatgagcttatgtgcaaaatcgttaccctccgccagccggtaggccgttcccagcttgaggaacgcccacaggatgaacagatagggaatgtttggaatgagatattttctgatcttatctgtcctcatgggccacctcctttgcatgttctttctgtttcggcttttctttggaaagctgatctgccgcctgtttcagttgttcccggatgggaacacggttcgattttgctttgcttaacaccttccgggagtactcggaaaagcaggcggtcatcgcgtctgcctgtccagccttgaaaaacaacaggtatttgtccggcccggttttatagaacgcatagtccacattccatttccgggccacgcggtcaaaggacttggcatccccggatagctcaatgctgtttgtggctgtgccgtgggccatgagctttcgcacactttgtttgccatgcggtacttgccgcccacggtatgccttgcggatcttccgacccaccatgcccagcacatacgccagtccccgcgccgtcagcttggtcgtttttacagatatggctatcgtgcgccgggaaatatcttcatcaatcagttacaccgcctccttccttgggacaatttgtctcgaagtgccatcaccgatccccacggtcttttttctgcatttgacggtagccctccaaagaagaaccgtctatgatttcctgataagcggccatttgctcccggatagagagcttcgggaaagagaacaccttatgctccttgggaatatcctgcaagccatgatacacttccacgaaatgatcgctttctttgacaacatagccgcccggggcaaaatggccgttttcgtggatgcagacatcccggccatacgcctcataatcgaaatacggttttacctgatccggcacatccaacatttccagatcgtccacataaatacgccccagcgtttcctcatcggatacgccggggtaaaagccgtaacagtccagattttgtgtcagattgatgatgtcccgcaccgaagaacagtgatcgccgctgtcgaggacggcctccagtgtttccagctccgatgaggtaagctcggaaagcaggcaggccagatgattaagctcatccagattttcatactcgctcaaatggtcatagagccccagcacatccccatcgaaagaggtaataaaaatttcctgatagcggacgccatccacgccgatccgtttcaagagagcctccacctcctgggcggttgtgggaaatttcagtgtttcacccacaagctggccctcgctgtacttccccgcgttggtaacgtaggcttcaaacagggtcgccatcagcggcggccctgtcccttgacggtcaggatgccctcaagggttgttgccgtaattcccagccgctgggccacggcgatgtcatttttcatggcttcggtcatactgtgcccgcagacaaccagcacatgggaacggcggagcaggtcacggctcatgtcgatgccgcttttatgctcctcgggaacagcatcgttgagaaacaggggcaagtacaggggcgggcaaataggagaaaagcctgcctcatacacggtgcggcaatactgcgccgccagttctgcgttttcgctatcgccgccgagccatgcagcggtgatataagcaaggggtcgtttcatcgttcatacctccgatattttaataagaaagttcaacccaaaccccacgccctttcccagtcttgggaaagggggcggctctgaaggatatacccccgccgcttgccggagaaatagcacagccggggcagaccgtcaagggcgagccgccgaaaacggcggtgcgctgcacccttgacggcccactcccggctgtactaaaaaacaggcggcgacgggggatatataccaccagagcttctgcgcgagggcggggccctcgggacaaagtgtctcgaagttgttacttgtcaagttcctgctttttcggggcttttgccagctccggcggctgtttctctttccagtcatccagcagggacataatctgttctttcattttggcgggagttacctccttgccaaaatacttttccagttccgcagtagaaataatcacgcctcgatcctcctttttctgttctgataagatgccgtcaatgacatcgccgttgagcttgccttccttatccagctcccggagccgtttagcctgggccagcgagggcgaagcctgctccccgtcaatggaaacagcaataagcctctgatttttcggtttgatgtaggacagttccacggcaggcataaagcccatctttttatcgtctaccttatccagaagctccggcacaagagagttgagccgcaagtagcgcatgacctttttatagttcatctcatgcgcctcgcccacaatctcaaccgagcgttttccaacatcgccttccgcaacgcctttcagtcgcccgccctgatgcttaatgtcctcaacctcaagttccagcagcgcggccaattcactggggagcatcccgtcacgctgcttgttgctgtccttcatggcctgcaccgcttcgtggtcggtcatttcacggacaataaagggcatttcctccagccccgccagttcgctgccgtgggtacggcgatggcccgctacaatttcatagccgtttccgtctttctccgggcgggcaagaccgggaaccattacaccgtttacgcggatagaagcaacgatttcccgcatcttcgcatcgtcccgtaccttaaaggggtgcggacggaatgtgtggaacggatgaacctcggaaagtttcagataaaccagcttgccttcctcaaccgggcggggcggtgtagtcggctcgggagccgtctgttccacagcagcagtttccttcagtgccgtatcctgtgcgggcttaatgggctccttggcatccggggcctttccatcgcttcgggacactttgtctcgtttggacggcttgggcttgtcaggggccgccttatccgccttgggtgggcggcccttgcgagccccagccgatttctccgctttctgattttcagtcgcggccttttctgctttcggcggacggccacggcgcggctttttcggttcctccgtgttggcgggctgcggtgtttctccgggggctgccgcctcctgcgcttcgggggtttccgccttttcgacttcggcgcgggcgttctgtctcttttctgccataagctcattgattttgtcaaaggacacaaccacatcgccgggctcaggtatggcaggcccggtctgttcctgctggggctcagacgctgcggcctgttcgggtgtggtgataggctcggcagcctccgggaaagtattctccgcagggcccgtattcaatttttcatcggccatttacgatcctccttttcgttaaagttgcacaaatttgaacgctaaaattttgtagttatttttgtgcctcctttccgtctatccacgcaaaaaagccgcccgtttctcatgccggacggctttttgcgtaatgtgatagatcaaatattattttttctggtttgtaggctccgaaaagccttgtatttacagtgttcctaataggaagtaatcataggaaagcggtgcaccacatggatgagcagaaatacagctataatgctatcccaccgcactgccaaaggacaaggtgaaccttcatgagaacaaaagacgaaatgatgaagctgctggtcaacacagctgcgcaggatgaacggatacgggctgcttatctggaaggctcccgtgtaaacccggatgtacccaaggatatgtttcaggattatgatgtcgtatatgttgtaaaagaaacagcttcctttcaaaaggataacggctggattgatcgtttcggtgaacggctttatatgcagtatccggaagacagtgtatatgatccaggagataaagaaaactgttacggatggcttatgcagttgcaggacggaaaccggattgatcttcatgtctgcacactagactatgcaaagacacatttggaagcctatcaaattctgcttgacaaggatggaatcctcccgcagccaagtaaaaaagcacttcagctatattggattcaaaagccttcacaacagcagttttcctgtacctgtaatgaatattggtggtgtttgaataatgtcgcgaagggattaaaacgaaatgaactcccctatgcactggatgttatcgattttacactgcggcctatgctaaaacgtctattggaatggaaaatcggcatttcctgtaactttcaaatcagtgccggaaaatgcggaaagtatatgaaacagctgctgccgaatgctgtatatcagacctttctagcaacctacgcaaaagctgatagcgaggcgctgtggcaggcggtgtttacgatgtctgagctgtttcatgaaacagctatagagataggatgtcagcttgatttgacctacaataccttggaggcattaaacagtatgaagtatctgagggatgtctattttctacccagggacgcgaaagaactatataaataaaagcagggcctattcttttgagtgctgtcacgctgtaaacaagaaaacaggatatagggaatgtatgatataaagcgaaatcaaattccagacatagcattttagcgatttccccataacaaatacacaggacgatgatgtatagaatcaccgccctctttttactattgattttctttcaaatacaccataacctcatcgctgttctccgcctgatccagcatatcgaaaaattcctgcttattaaacatctccagaagctctgccatagcacacagatgcgtctgattatccgtagcgctcagactgaaaatatattttaccggatcattgtcacggttaccaaactcaatagcgctgtttaatacgccaactcccagtgcaacagacaacgctcctgcttccggcttcacatgcggcagcgccacatgctttgtaatcacgatatatggccctacgattcgtacactgctaatggtttcctccacataattctgtgtgatatagccatgctgtaccattggctcataggcctttcgcacagcctcctcccaattatcagcatccaaatgcagacggatcagctccggcttcaccatatccgcaagatgcaggacacgttcctcctgtgtagtcgtgtcaatatgggagaaatacgtaatcagctcattgtacaatgcatgctcattctggatattcgcatattttgctacgatccccatcacgacatcaacattgggctgctttaaaaaatgacttcccatctgcatgtagacctcgcgcattacctgatagcgctctgcaatggacatgaccggacttacccgaatgacaggcgcatggatacccgcacctaaagaaacatagcttgtggaaaatatgatatccacatgctctttgacgtcatggatatgcgaggtttccagcggtggcaaaaagtgcagctcgggaaacataccggtaagctcgttataaagaatggcagagctgccgattccattggaacacaccaccagtgcagtcttctgcttcgctatttcaaacgctttctgatcggagtaaatggaagcaaaatgcatggtcagatatgcaatctctcctgccggaatatctccaccgaaaatcacatgaaacggcttcatggtttcctccacaagctgatacagctcccggtattcctccctcaccttgtcacacagcggattgaatatcggcagacggcagagcagacggtaataggccggtcgaaaatgagaatacagctgaatgaagatttcctcggtattgcggtaatgggctccgctcagatattcaaaacgggtcatgatttttccgatgatatcggagatcagtatacaatccttggtctcctcattgatatcgccaaaggaaattcccagtatccacgaggagatataattgatatccgtatttgtaatattgtcagtgttcttgtaattctttaacagctccaccgtaaactcatattccttcatcgaggatattgcttccatatccagcaacgcatggatttcctcctctgcgttttttccactctgcatacgtgccttcagaaaaataaaaatataaataaactccaccagacggtcttctacaaaccgaatgttatgccgctgtgcaagctccgtgatcaccagccgtgaataatcaaaaatatccagattgaaatcgtcgataaagacatcgaagattttagcactctgttcctcggcaagtgtataaatgacatacttcatcatcattctgcggatttccatttcggagccaatcagataatagcccttggtccggttgtttctcacccggatgccgcgctcctccagcatttgtgtcagttccttgaaatccagcagcaccgtgcttctgctcacaccgagagaatcaatgaaatcactcaatgacagatactcactgttcataaacagcatcagatacatatagatctgacgttcctttttgttcatgtaatactggctgctttgattcatctcctgaagcagctcctcaagcttctgccgtgctttggaatccaatcgaatttccttcgctgttccaatggtaatgatgggcgcatgatgctgccgcagcagatcgttcaccttttcaatacgataggttgcctgacgacgggtaatgccggcacttacttcgatatccttcagagtgagataaggcttattggacagcacctgcatgagtgccatgagttcattatccatacacatacctccccatatgatgcttacaactagattttatctgaaaacggtatcactgacaaagtgttttcggtacaagttttgttttgtatacgcacaaattttgaactcaaaaaaaggcgcagctcatcatacgcctttcattgtatcataatggcttttaaaacgttatcccgccgtagtttgcatttcctgtcttgcttcatcaatcagcgttctgattgagcgtgcattggctgcgatttcttcccggctgccttttgtgagaagtgagccgaagccgcagcagtccacaccacgcagcacataatccttcagatttttcagatcaattcccccgctcgcaagaatcggcatatagggaatcggcgtcttgaatacggataccagtctgggaccatagaaatcggaaatcggaaacgccttgataaaggctgcccctgcttccagagcctgaagtgcttccgttaatgtcgtgcagcccggcgcatagggaatctgataccggttgcacataacggcaacctccctagaaaaattcggtgctatgataaactgcgcattgtgaaggatggcatgtctggctgtttcactgtcaagcacggttcctgctccgatgatcagacgatcctgaaatttctcacgcagagcctgaatcacctcacctgcattgggcagcgtataactgatttcaagacagctgacgcccccttccagacatccgtttgcgatttctattccccgctctatcgtttcgacacgaacgattgccatagcgcctgtttccgctatgcgttttgttagctctgctttctgcatatacgtacctcctgttgttttagctttctgccttttgtacaacctcgaaggatatgtgatgggtatgaaggcagtccatggcatacttctgtacatcattcagcttctttctctgaaagagatagaccgcccctgcgtattgccagccggaggggtgcgtcacatgatctcctgagaaaaagagcttgacagagctgctgctgcgaagaatttttaccgcacggatatccctatatttcaagtgccgctgctctttgggaagtgccggaagaatcacctcgtcgcgtttaaattcacataccggggtgtttttgacaagccgaaagccataacggcacatggcttttacagaaaaccagagacctgtgatgcttaagaacgcaagcaggaaatgtccggaaccgtaaacatagattgtcagcagcataagaaatatggttaagcacagattcagcagcgtatacagtagcagctttcctctgtcttcccgtacgatgtattccttcatatccatcatcctttcccgtgttgttatatgagatggtaatgctgcagcatctctttgattttctcatcatcctgtgcactgcattccagtaccggctttcttgccggtccgatttccgcaatccctgccagttctgccgcacgcttcatgacaaccggtaccgttcccagcttcaatacgccgcgcagtacatcaatgtccttctgcagtgcctctgctttttctgtttctcccttacgcagtgccctgtccagctccaccagcacctccgttatcacattggaggttcctgccacagcaccgcttgcccccaaagcatagccatagctgattttggaatccgaaccgatcagcagatcaaaatcatcccgcttcgcaagctctgcgtatgccttcagattttcttccttaccactgctgtccttgataccgcgaatgttttctacctctgccagacgtcccacgacctctgcgcttaagttacagcctgttgcctttgggatgttgtagagaatgatgggaatacttacactttccgcaaccgctgtgaaatgctgtaccagctcttcctctgtcggtgtcagaaaatacggtgtgatgacactcagtgcatccgcacccagctcctccattttctttgacagacggatggtttcctttgtgctgcatgcccctgttcctacatagaccggcacacggtggtcaaccatctcaatcaccttttcggcaaattctattttttccgcttcatcgattacatgaaactctccgttgcttccaaggatgaagattccctttaccccctttgcgatcagatggtcgatcagctgctgtgtcgcttcatagttgatactctgttcctcatcacgatgaaacggtgttacgattggtgttatgattccttccagcttcatttatctgtccccgctttctttgatacttgcgcccagactgccgcccggatgccatttcacatactgctgcggtgtcagattctttgcgttctgtaataagatgctcagactctgcagcatgaccatctctgccagtatagaggctctaggcggcttgttcatagcatccccctcctgattgacaccggcgatcagggtgacgtccccctgctttgccagccaggaatcggcctttccggttactgcaatcagcttggcaccattgcttttcagtgtatctacagttgccttcagctcggtagtctctccgctgttggaaattgcaattacgacatctccactcagcacctgtcccgcactgccatgtaccgcttccgtaccatgcagctcataggttggtgttcctgtggaggataacagtgatgccgcatatccagccacatgtcccggcttgccaattcctgtcacatgcacacggttatgattttgttccgcctgcagaatcaattctctggccgcaatcagcgcctctgcgtcaatgctgtctataaaattttttaattcgctggattcgatatccagaaactcccgtatctgttctttttctactgccatatcattacgtcctttccagttgctcatattctcttactgcctgttttaagccttcccgcatcagtgctgtatcaatagcggaaacaagcagactgctttcctttttaaaatattcctgcatcgctctgccaccgataattccaaagcccaaagctcgtttcaagcaggcatctgcgaccttttgaatcatgctgagctcttcctcatgcatgagatcatccggcctgcccagcgatattgccaaatcacagggaccgatcagaacaccgtcgattcccttcacattcaggatagcttcgatgttttccacaccctgctttgtttcgatctgtacgatactcatcgttttctcatttagctgtttcatatgcagggcatgatttcccccaggggcatagtgcgtattggctcccccggaatagcttcgtttccccagcggtggatatttgctccactgtacaagctgctctgcctgttcagctgtttcaatcataggcaccatcacaccggctgcaccgtaatccagaattctggatacatctgatcttgccagctgtgcaactctgacgatggatgaaagctttcgcatattgccaagcaccataagatcatgcagctgttcataggacaggacaccatgctcacaatcatacaagataaaatccattccgcaatcctgtgccatgatgaccagagaaggatgcgccagtgtttttacaaggacaccctttgctttctgctgcttaatcagctgtttcagttccataggacctacctcttttcaaaaagaaggacaaggactttcatccctgccctattcgtgaatcaggcgaagattcccagaatccagttcaggaatgctccgataatattgtaatcgacgttcgggaaggatgctccggaaattcccagtcctgcgaatgcaggatacagaatcagcggtagaccggtcaatgccataccaacgatgaaggaaccaaccaatgcgcccttccatccgccataggcatttccgaagataccgcaggtaccaccggagaagaagcagataccggctgccggaatcataatgacactgctgttgcatgcaatcatgattgccattgccgcaagaccgcctacgaatgctcccacaaagccgatcaatacagctgtcggtgcgaatgggaagattgccggacagtcaactgccggtttggagtttggaatatatttctcagaaattgcaacgaatgctgcggtgatttctgcaataaactgacgcacaccataaatcaggacgctcataccggccgcaaactgcagaccctgcaggaacggatagataaaccagatatcatttcctgctttttcaagcacgatatccatatgaccgtttaccacacaggcgatgacagccacgtagaacaatacaaccatgaacagtgctaccgagaagataaagtcacggaataattcaaagaattttggcatattaacagtgctggcatccttcttctcttctgtgctttttcccattttaccgaataatttccctacatatccggagaatgcgtaaccgatacagttaaagtgacccattgccaggttatcggcgcccgtgattttattcataaacggctgacagaaggatggcagtgctgctccgcagaatccaagcaggataccaccggcgattaccgtaagcggcatcggcagaccatttgcaataaaaatcagtgcgataacacatgcaaagtacagaaagtgctgtccggtaaggaagattgccttaaatcttgtaaatttggcaacgatcagattgacaacgaagcccagcagcataaccaaagccacttccgtaccataggtattcaatgcaagacctgttgcgacctctacctgcgtggtaactccttcgattccaaatgctacattgaacaaatctgtaaatgtctgtacaacacctgacattgctgaagatccaatgttgaagaccataaatccgataactgttttcatcgtaccgctgatcacatccgttgcgtgctttttctgcagcagcagaccaatcatcgcaatcagccccataatcaatgcggtatttcgtgattgcgctaaaatcgcatctaacatatgtttttctctcctttagttattttttatacattcccttgttcatccctattttgtggcaagaaactcttccattttggatttcatttccaccttgtccatgatattgcgaatccccagtgcataaggaaccttgtcctttaattcatctgccagatcatccatcgtgataacaagatccccgctaaatccattcagtgaatccagatttccatgctctgtctggatcggatagccgttttcgctgatgacctgatccgccttgattttcaacagcatactggatcccatgcctgcacggcaacatactaaagctttgtacatatcagtttcctcctttttctatttactgatgtattccatgatttcctttgcgctctctgcatgttccaggagcctgtaaaattgagcatcctcaaacattcccgccagctcagccagtgcattcagatgttccatgttatcctttgcacttaaacagaacagatatttcacaggatcgtttgcttcatttccgaagacaaccggtgtctttaaggttgcgataccaatggcactttccagtgctccggactccggtctggcgtgtggaagtgcaacatgcttggtaagaacaatataaggaccgttttctttaacccctgtaatcatgtcatccacataggacggcttgaccttgtgttcgtctatcagcggctgcgcagatttgcgaattgcttcttcccagtcagcagcttcaatgttcagccggatcagcttttcatctgtcagatctttcagcatcatgtcacctccttcacgcttcctcgtttgctttacacctagataataaaagagattcaaaaacatttcaatccaatttaagttcaacttttgttttggataatgacaggatatgaactcttgaaagccctttatttataggcttttcaaagcatttaaccatatatttgtaaagtcttatttttgttttgcgaacacacagactctgtactgaagttataaaaagccggtaaataacgtgctgcagtgttatctctatccatacaaaaaatgtgatgtatgcagttgaagctggctgctgttgtcagtgctgcgaccactgtcatcaaactgaaggaaggcatttcccgggaaacagaattcttcgacaaaaatatacagacatacaaaaaggatgcagcatattgatatgttacatcctttttctatttgattactgatttacttctgcatattttctccgctcaggactcagattatccacataatagcggattgtcagactcgctgcgcatttgcttttgttttttggctctacgataaagccgtcaccctccagcatagcatcaagcatagccttacagcatacattttgatttcttatgcccggctcgcactcttccagcagatccttcgcattcacttcgatgtacagccactgcttgtcatgtgcttcctgcttctttgcctgtaaacagttaagataatcctgcattgtcagtttttccatagatatttctcccttctgttctaggatatgataattattcgccctcattatatcatgtttctatagataatcacaggtttccgtgaaattttaagctacctttacagcctgtatgaatatggtttcatcctattttttctttcagcttatcaatacaccagttggcccatttgatttcattttgatagtacataaatccataggtcattgtcattccccagtaaaaggattcattatccttgtgaatctgtgcttcgaattccggaatcttattcagatcttcattcattttatcaatgatatcagaacactcccgtatgtatttctccagtaggcgcatcgtcttatcaatatcgatattgctggaaaagaatattttaatcagcagcggattcttgtacttcatgatatcctcaagatccgcatccgccagccagcggttaagctccagtcttccctcatcagtaatatgaaacacctttttattcggcttatcactctgatatacaatctcactgtccacccagttatgctttgtacaggtgttcagctccttatagatctgcgacgtctgcgcatgccagaaaaaggcaatgcttgacttaaaataacggtcaatatcataacccgtcatttccgcatagttcaacagacccagaattgcatgtttcagcggcataggtacccttctttctacatttgcagtattctactattagaatactataggaacggcaactttgcaactatattctttcttgagaatcaccttcgcgatttcgtattgatcggattgcatgcatgattttctcattgttttccgtaatcattgcttgaaattcctttgttttctcttttaccataagttcataattatcaatgagaccctgtgttatttccttcatatcaatctcattcagctttgcgactggagaagaaattctaaccgtatccgccattttctgaagcgtcttgtttggctgcagctccttgaccttatccataatcagcttagtcttacggcggtcgatcaaatcctgcagggtgatggtcgacatttcctcctccggaatatcctcaaacagcgatacataccgggatacatccacaagcatcagcttatacagctcttccatggaacagccgctgtcaaaatactcgtccattttagcgacaaccctctgcacccgttcctccttcagattcatgaagaaatcattgatgaaatgatagaagaacttcggcataaccgttttcttctccgccataacataagcattgtcccgaaaatccatcgcatacaaattgtggttgtgatacagctcctccatgtttgtacatggataacaggagcgcacataaaccggttcttttaaattttcaaaaaacgctgaaacgcagtcattctcattctcaaaaatcagcagcttttccagaaattccggatccttggcacgctgttcatacagggaaagaatcggctttgtgatccccggtgcattaaagcttaccacctttaccaggtaatcctgcagctcttttttcattgtcaaggcaacatacagcgacagattgccgcccttggaatgtccgcacatataaaagggtttttgtatatctgttttctgtatctggtgcagtgtaagaatctgttgccaggtggggtccttcaaaaacatacggaagttgtccttccagtcctgccatccggttttgtgatgtacatcatccagcttttcacttccgcggaaagcaaatatcaaagcatcctccatctcaaatgtataatacacaacaccgctgtctgcgttatcgttataccattcctttactgtcatatgcgcatattcgtccgggttgatctgacggacaagcttcatgttgttttggaaatctggatactgaccgtaatcctgcatcagctgctcatcctcctgtatatgccgaatcatatccgaaaccggtatgttcaccgcataggtatcaaaataggaaagaagagaaagctcataaaatgttttttcacatagcatcgtcatcaccctcacttttttcatcattataaaacttttcttaagaattacaagagttctttcctttttttaagaattacgatacactgtagaaaatggaggaaggcatgaaaaaaaacgttcgtaaacgcaagaaaaagaaaattaaccgctatattcccatacttgccagcggacttctgattgccctgacggttctggttatctcatgggttttctctgccagaaggacctatacggttgtaatcctgaaagaaggtgccgagcaggagtatgcacaataccattctctggcgcaggcaaaggaagaaatgctgacgcagacaaaacgagcggaaaaacaaaatgcaggtatccgctatgatcataagctgattgcgatcggttatggtgtcgtacaatttcaaagaaaggactgtacgctcaacacctcctaccgtatggcagaaacagaggaaacaggctatacaaacggctgctatggaaatgatgccgcctttgtcgatatcagtgacgacggaaacgaagtacggtttcgtcaggcaggagtggatggctgggcagctgtcgatgaagtcaccttacataattattatgacgaaaatgatgtggcgtccatcaatcactatactgcaacatctcatctgttaacgcataaaataacaacgaatatagcagaatccagctacgccaatgagctgtccatgggagaaacagggctgaaggatcacgcctattacagctatgacggtcattatttttattccacctttgaagatatgattgatgattatcgtaagggaagtcatgaaagagccgcaaataaagaagccttttacaattactatcagtttctgccgcatcgcagcatcagccgctatgcagcggacgatatcaattggtatgtggaaaactatctcggctttgcgtcctcctcgcagtctcttctgtatgacagcggcgcctggtttatagaggcgcagaagcgttatggcacaaatgccatcatgatgttcgcactggcaatgaacgaaagtgattttggacgaagtgcaattgcacgggaaaagaaaaatctgttcggtcatgcagcgtatgatgattccccctcacaaagcgcctccggctataaaagcgtaagggaaagcatccttgcgcatgcggaaaagtacctgcaaaacagttatctcaatccgttgagcgatctgtatcatggagggttcttcggcgataaggcaggcggcatgaatgtacgctatgcctcggacccctactggggagaaaaggctgcggatttttatcggaccttcgatatggtgatgcagggaagggaccgtgacatttcctaccttgtcagtgaacagccagtcaccgtatattcctcaaagaaaaaagacactgtactgtatagggcaggagctgttccttgctctcatcttgtattgaagcaggaggatggatggtttcaggtgcgcagcgatggtcctgtccataacggaacgctacagaaaaacagcagcgcctatggattgaaaaacgcctatggatttatacaggaggacttgacgaaccaaatccgtatactacaataaagagagaaaaggcggaagcctttctgaaaggagaagctatgaataaaaaaggactgttatttgattttaacggaacgatgttttttgattctgaaaagcataaggaagcatgggatgtattttctcagaaatatcgcggatgtccgatttcagattatgagctggatcatacccatgggaagacaaacaagaaaatcatcgagctgctgctcggcgacatgcgtgatgaggagagtgaaaagctgtccaaagcaaaggaagcgctgtatcgcgagtgctgtatcaatgatccgaagatgtttcatttagtggacggtctggaggatgtactggataatctgaaagagctgcagataccaatgaccatctgttcagcatccattaaggataatattgatttctttatttcttcctttcaccttgaccgctggtttgatattgataagatcatttatgacgacggcacccatgtcgataagatatctatgtttcatgaaggtgctcaggcaatcggagtaaagctggaggactgtatgattattgaagattctctatccggtcttgattttgcatatcgctgtcagccgggcagactgattgcgattaccacgccggagcgaaaagctgcatatgagaaaattgcaggtgttcatgcagtcatccatgattttcgcaattttgatacctctttctttttaaagtaaatatttccaatataaataggtaaattttgacaaatgttaaaaaaaagttgattttacatataaaataggttatattaactatgttagtgttatcagctggcttactctttcttcccccacccatataggtaagtcagtatatcttcccccagatcgataacactaacactttttttatgtcatgatatacccgacattgcatatcgtacttttcaaagcaatcgtcgttactttataatttcacaccgtcatacagaaaaaggctcaagctgtttcctttcgttaggatactcttgagcttttttccagtttgaaacaggcaaagaggcgtatgccatattatcgcctgtgcatacaatgtttacagaggtagcagtgccgccgctgcctcatcaagaataacagtgacatgcggatgcagctgaaagatagataccggaaattccattgtgacaggatccatgaatgctttctttgctgtttcggctttttcctttccgcttagcagaaatataatattttttgcggacataattgtttttggccccatcgtaatataatactccggtatccgggatgtatcctcactgtggaagtcatgatgcagcagcttacgggaatactctctcagatatggtgtttcatctgttcgcacaagccgtgttcctgcgttccagctgtcaaaggtacccggttgatttccacagaagtggccattcttcccgattcccataatcacaagatctaagcctccctgcttctgtatatccttatcaaaggttttataattttccatattcaaatcgtgaatatgatccggcgcaacctctgcggcgtggaaatatttttcatccagactgatttgtcaaacggatatttctttctcatgacgttcatcctgaatccagaattcatcaaagatatagtaatgcaccggatcaaaccacggccggccatgcacctgtttggcaagcagtcgatatccctgtatacaggtgcttccggttgtgatagcgatattggtacgttctttttcagtatgcatgtgcttcagcatcagctgagccataacctgactcagttcctcataatctctggtaacaataaatttcatagcattctccttttccgtaatattcgcagctgccgtatgaactgaaatgcggatgtacctgtcacagtaagcgccagtgtaactacaacaggattctgatatgtctgattccataagataagcagtgggaaggcaatgagaaatccgctgataataagcagcttatgatgttgtctgcgcgatatatccatctgcttcggcagtcgtttcacacaggaaagccgtggcagaaaaacacgatgttcatatagcttcagcagtactgccagcatacagcctgctgagacagccagccaaagcggtagcgaaagtcccagcgcagcaccgcaaagcgcagtaccggcaaacaaagccccgtgcaatacctgaaatataccgcactgctctgcgggaatgtgataaagcttatgatgcttggtatcctcgatatattgacagtcctgttcaaagcggtgtacacgcagcattacagcagctctttgattttgcctgcggcagcttcatccagaacgactgtcacatccggatgcagctgaaaaatggataccggaaaatcttcactgataggtccgaaaaacgctcgtttcactgcctctgccttttgttctccactcatcaggaagacaatacttttcgcagccatgactgttttcggccccatggaaatataatgattcggaatacgtgctgtatcgtcgctatgtaaatcctccttcaacagctgcagcagcagttcttctacaagtggtgtcgcatgtctgtcaatacgatgggtacccgtattccagttatcaaaggttcccggctgatttccacaaaaatggccattgcttccaactcccataattatcaaatccaaaccgccaacctgctgtatatcctcatcaaaggtgtccgcgttactctcatccagattgtgaatatgactctcctctacatccgcaagatcaaagtatttgtagtccaggctggcacggcagataccttttggatcatccttataccagaattcatcaaaaatgtagtaatgcacattgttgaaatatgccttccccttcgtctgttcagccaggatttgatatccgcgaactggcgttttgcccgttgtgatagaaatattgacacgctccttgtcgctatgcatatgcttcagcattagctgtgccataacattgcttacttcttcatgatcctttgtaattataaatctcatacattcaccggcagtttattgaaactgccttttcctttccgctgatactggggaatcagcatcccgtttacaaaagctcccttatttcagatgccgctgcttcgtccaaaagcacgcttacatgtggatgaagctggaaaacagataccggaaaatccatagtgaccggaccgaagaatgccctgcgtaccgtctcagcctttcctttccctgagaaaatcatgacaatattttttgcatccataatcgtcttcggccccatcgtgaggtaatgatcagggattctcgacacatcatcactgtgaatgtcatccttcaacagaaattccagcagctgattcacctgcggcgtacagtagcggtcaatgctgtggcagccctgattccagtttgtaaaggtacccggatggttcccgcagaaatgaccatccgtaccgattcccataagaaccatatccatgccgccaatctgttgtatcgccgcatcaaagctgtccacggtttcatcccgcagagtatgaattctctcttccgggatactggctgcctgaaagaattttaaatccatgctcattttatttacgggaatatccatatcctgagttcccggctcctttgcataccagaactcatccaccacatagtaatggacatgttcaaaatacggcttgtctttcaccaggggagccagtatttgatatgcctgtacgggcgtcgtgccggttgtcacgcaaatattgacgcgaggccggtctgtgtgcatatgcttcagcatggtggatgaaatcacctgactcagctcatcataatcctttgttataacaaatcgcatgcttatttcctcctttccttcatatctttatcttcattataaatactctgatgacagggcagggaagtgtcgacactttgaacacttattcccatcattctggcagttgccggctttcttttttcatgttctcttgattgaaattcatatattagcagcatagctcaatactaacagcagaacctgataccttttacttcatgagggcaggtctaaagacgcattcgctgacgatatttcctgcctatgtatcgaaagtgtcgacacattacatatggcgtccgtttccctttaatataaaagtggaaagattgggtgcagaaaggagccgcaatgagtagagaaacaaaaaatgaagtttatgaatttattgtaaaatgcacatttgaattttgcagcaatcagctgctgaaatgtgattccagctacttaagcaagcgcctgaacatttctcgttcgcttgcctcacagtatctgaatgaattttacagagacggtatctttctgaaggttcaaacacgaccggtttattttctggatcggcatacacttgaaagtgtatatcagatcaagctggaaaataatgaattttacgatgaaaaggagctgactgatcagtttggtaggtctttgcgaacaaaacgaagctttctgaaggctgttggacatgatacctctctcagtgaatgtattctgcagtgccagtctgctattaaatacccgccaaacggtttgccaatcctcctttacggggaacgcggcgtgggcaagaccttcttcacacgcctgatttaccagtatgctatcgaagaatcgctaatagacaaagatgccagactggtcttctttaatgaaagtcagtatgaggaaagcaatggcagggaaaaggatgtacaaatcatcttcgggacttatctggacaacggctcgcagaaatatctaggtggtttgattgccagagcaaaaaatggaattctggtcatagagaatgttgagcggctttcaccacagtgctactttctattgattcagtacatgcaaagtggtgaatataccatttcctcaggaaaacagggaaaggtatttaagtccagaacccgtattatctttaccagctgtatagactcaaagcagaatatacataacgctttctttcacagcataccgattatctgtcatatcccaagccttcaaaacaggccgatagaagataaggaaatgctgatcattgaatttttcaaagaggaaggcttgcggttgaagaaaaatattctcatttccagcaaggcgtttatcgccctggtgaatcatacctatgaaaacaatattgaggaattatcaacctgcatacagtcgagctgtgcaaatgcctatctgtcacacgatgtatcggatgatctgcacatatatctgtatcatcttccggtatctattatcaattctttgactcttgataaaagcaatagtgaagaggaatacatgattgatatctgcaaatatctgccgcagacaaaaaatggaagaatcattgatttcttcgattttattgtgactgcctatcgggaatatgaaaagggaagcatcgatctgaagctgtttcttgaacgctgcattgataacatgaatgtctattatgactatatcgtatttgagcataaatattacaatgcacgcgttcgtgcctatgaaaaagcggttttggatgtatttgaacatatgctggaccgttatgatatctacataccatccaattgtgctttcgttgttgcacgcgttatttacagctatatgcagatgttttcttccatccgcagctatgaggtgcagcatgccgaagaaatcagtaaggtcattcatctgttaaaggagcattatcccacaggctatcgaagcgccatggaaatcatgaccaagatacgacagacaattgatgtggaaatcaatgatatgaatctgatatttctgattttgaatattcagttttataaccgttccattgataaataccgttacaactgcattattatctcacatggctattccactgcctcttccatagcagacgctgcgaacaagctgattggaagccacattatggaaggaattgatatgccggttagtacgtccatggacgacattgtcatgaagctgagaaaatatatcaacgacaacagtatacgaaaggatttgattctgcttgtggatatgggatctctggagaatataggtacacagctgattgaagaatgcggcatcaatatcggaatcatcaacaatgtttccacccgaatggccttgcatgtggccggagagatccgcagaaatgtagaaatgaaggaaatattgagcaaggtaagcagagaaaccgtatgtgaatataaaatattcagcaatatcaatcgcaaaaaagcaatcatatttacctcggaaacaggaatggaagcaatcgagcgtgttgttcagctttttaaaaacagcatgccccgacagattgatatcagtattttcgcctatgactgtctcagcctacagaaaaacaaggaacaggatgatatattcaagctgtatgatgttttgttcattgtcacaacaacacggttagacatacgcaatgtttccagcgtaccgatggaggatgtcattgcattcaaggatgtggacagtataacctcaacactgaacagctacttcacaaagaatgagcaagagcagtttaaccggaatctcatcaagaatttcacattggaaaatgtcatgaattacctgaccgtactcaatgcagataaactgatcacctttattgaagaagcactggatcaccttcaggagctgctgggtatgctgatcgccaatgaaactatggttggtatgtacattcatatttcctgtattatagaacggcttgtcatgaaaaataaaatcgcccggaaggaacgtggttactctttggatgtagaacagaaacggtttcagaaaatgttcaacgacagctttgccagaattatggattactacaaggtggacatccctgtgagtgaaattctatatatgtatgattatatattcaaaaagtagtgcctgaaccatgcggaggcctgagctcaccaccgtgtgtacaataaggaaagaaaggagagatttgtatgatcagtttgtttcgaattgattttcgcttactacattaccagacttcacaggtgtggccgaaaaaactggatatcaatatgatcgttgttgccaatgatgcagtgatacaggaccctctgcgtatgagtctgatgaaaatgtcggctccggcaaactgcggtctgaagattctatctgtagaaaaagcagggttgtttctcatggatcctaaaaacgaacgtcgaagaattgagttgcttgtggaaacaccgaaggacgccttgcgtatcatccgcagtgtacccggaatacagcatctgaatgtagcacttatgaaaggcggaccgggtaagaagatggtatgcccttctctggcttttgcccctgaggattatgatgaccttcgcagtatcgtagacctcggcgtgaaagcggaatcctatgttacaccggatgaacgtccggtatccattacgaagtatttataagaaagagaaaaaggaaataacaaatctttatctatgttgtttcgttaaaatttactcgcagaaagcgggagaatggagaacttatgcaaacagctatcttactgggccttgtttatgcatttgcatggtccatggacaatatcgccggaagctcctttatggacagaccaatcgtatgcggtgccttaacgggtctggtcatgggaaatttcgagcaggggcttgttatcgggggaacactggaactggtatggatggggtttatcagctatgccggtatcatcaatggagaaacgcgtatcggggcgattttaggaacttattttgcactggcaaccggaaacagctttgatgtcgcgatttccattgcaatgccaatcgcgattctgggcgggaacgtatccaatgcttataacattgttgtcagctatctgatgcatcgctgggctgacaaatgggctgaagaaggaaattataaaaaaatcggacagtttcacctcggtgtcggttttgtaaagctgttcttcatgacagccattgtctttcttaccgttcttctgggaaccggggcgattacgtcactgatcaatgtcattcctgaaaatgtattgaacggtcttggcaaggccggtgaaatgctgactgctgtcggattcggtatgcttttaaacattctctgggacaaacgttttatcggtctgtatttcgtcggcttcgcagttgccgctttcctgaatctgaatgttatcgctatcactatcatcgcaacaggtcttggctttgtagccatgtatgcatcaggtaatgagaagggagaagacgcatatgagtgagaaagcatttgaaattacaaagtcagatttacacaaggtcttttggcgcagcatgccgattgaaatttcctacaacagtgagcgtctgcacaatatgttttatgtctattcccttactccgatatttaaaaagatttataaggatgacccgcagggaatgcgggatgcactggtacggcatatgcagttctataatacctgtccgcaatttgaggcaattgttgtcggcatcgttgcagccctggaggtgaaaaacgtcgaatccggtaataccatgggacctacgattgaagcagttaaaacctctttgatgggacctacaggcgtaatcggtgatgccttctttcagaccggcggctttcgcatcatatccgccagcattggggcttctatgtgtatcgcaggcaatccatttggtctgcttctctatttcctgatttataatgtgccaaattatctggttcattggtggggtattcatcagggctttaaaatgggatcggtcttcattgaaaaggtcgttaactccggcgttttgcaaaaaattacagatttatgtctaattgtcggactcagtgtggttggagcgttgacgagtgcttatgtgtcgttgtctacaccattacagatcagctatggaaaggagcctatcattattcaggagctgtttgatcaaatttgtccgaatcttctgccgttgcttctaactttgctgtgtgcatggctgatgcgtaaaaagaatgttaagcctaccgttttaatgatctgggttattattattggtgtcattctgggctcctccggtatcatctgatatggaaggtgccaagacaacagcaaaggaacaggaacgcactgcattactgcggacgattactgatgaacctttgctcatccgtagactcctacagcataaaaaagaactcactgaggactttgttcagcattttctgacacatacagtaaaaaaggtttatttcagcggacaggcatccggcacctttatagggaatatgcttgccccctgtatggagaaattgctgcaggtggaaacagaggtgtgcaatcctgcctcctttcctgaatattttcaatttaacatcaatcagcagtatagcccggatgaaatgcttatgctttgccctgcacattcaggaacaacaatcggaccaatcaggatggcacaggaatgtaaacggttgaatatccctgtagtatgtataactattgattcgaattctccccttgcaaacctttcggatatcgtcatcaataagctatgcggttctgaggaaagctttatcgaaacacgtacacatatggcatcactgctgataacatttctctgcatcatagaaacggcaaatcaaaaagagctcatcagtaggcagcaatacacatattatcagcaatactttaccagattggaagataatgtgaaacaaattataaaggatacagcagactggtataaaaaccatagggagctgctgcatacgaaaatggttgcacgctatattggagccggtccctactatgcagttgcacaggaaggtggtttgaagatcgcagaagctgcatctattgcagctcttgcttatgagcaggaggaatttatgcataccggaaccacacagatacaaaaggatgctctattatttttgattgctccagacggtgtacaggaaaagcgaatgctggagctgatacgctggtgtcggttatatagcgattatgtaatactaatcgcaaatcattctcatccattgaaagattccaaagcactactgtgccactttcaagatgatccgtattgcagcgtcatggagtatatggtcccctttcaaatgcttgctcacctgcttgcggaagatagaggtctgagtgttgttcatgcggcaaatgatggtgcatctgcttatttgaagacgcacacagaggaggtatgattcatgaaatacatcatagcgacccatggatatcttgcggatggctatgtcagttccatacaggtgttaacaaaaaagaacaatatttacgctgttaatgcctatgttgatgacagggatgctgcgctgcaattaaaaacaatcattgaatcctttgagaatcaggaggaaattatcattttcacagatctcatgtgtggaagcatgacgcaggcggtagctccttatctggacagatataatgtacgttgcattacaggaatcaatttaccgctgattctggagttcgtactaacgacaagcaccattgatgacgcttatatagaacacactattcaggaagcgcagaaacagatggtgtttgtcaatcacctactaaagcaaacacaataaagcgaaggacttattcaagctgtataaaatgctataattttgtgaaagcatattaacgtaaaaaacgttagtcgtgaataaagcaattatagcaagctgtggataagtctttttatcatgtatgctaaaataaatgaaaagtaaaaccttttttcaaatcaaatcgttaagtaagtgaggaggcggcatatgagagaacagcagatcctgcataaaataaaaaaaggcgatcagcagacattaaataacttcatacaagacctctatccatacgtctattccttcacatatcgcaaaatgcagggagacgacagtgcaaaggatattacacaggaagtgtttgtgcgcttcatccgtcagcttcccatgtatcatgcgcagggcaagacgctgcattacctataccggattgccagtaacctgtgtcatgactatcaccgaaaaatgcagcgtgatctgcacacggatattgacaggcaggaaaacttaatttctgcggacagtgatgtacatgaagtcattctcgatcagatacgaaatgaagagcttatgtattacataggggagctgtctgattctcaacaggatgtaattctattgaaatactaccatcagatgacatttaaggaaatagcgcagagcttctcaattcccgtatccacagtgaaaacaagacacacggcggcattaaagcggctttgtgcattatggaaagaaggaggttatcatgaaacagaaactcatacaggtagatgaggcagcgatggaacaaacgattcttctctgtcaaaaagagcaggaacaatacatacaaaaaaactgcacctctttgctacagctgattcttcgctatatgtggctagattttcgcttctatatgatcctatctattatcggactattgatttcgatactgctgataacgctggatgcagtcaatgctcagatttacactgctatttactttttcatactgggtatttctgcactttatgaatattataaatgcagccactacaggatgctggatatcatcagtcctgtttacctgaatccctgtcgcgccttcctgattcgtacagccggtatcgccttaaacgggctcgtgatgtcttttatattactggtgatattcatccttaaagaatcctggattcctgctgattttatcatgaccggtatcgttccgctgtatgccatgcaaattatttttacacatttaatacacagaatcaaaggctatatatccgcacttgccgcatactccatgttttattgtatatatctttttatatacagtcagtatatccggtacatgatatccaatcctcaggcggtgctggttatacttatcgtttcttgtttaacgcttttcaatatgcggcagttgaataaagggatgtcggatacagaaaggaggcagcaaaaatggagctggttatagaacatatcaataaatcattcaaaaagaatcaggtgctgtatgatgtaaatttaacgattgaaaagggtgtacatggcctacttggtgcaaacggaagcggcaaaacaacgctgatgagaattctgtgcggactgcttccaaaggatggcggcagcatcagctatgacgaaatagacgctttaaaacagtatgatgtctatgcgtcaaaaatcggctatatgccacagcattttggtttttatccgcactataccgtctatgaattcctggaatatatgagtatactgaaaaatcagtcaaagcaatacagcagaaaaagaattgacgagctgctgcatattttgcatctggaggataagcggaaaacaaaaatgaaacagttatccggcggtatgctgcgtagagtgggaatcgcacaggcactactaaataaaccggagattctcatactggacgagccgactgccgggctggatccaaaggaacgcattatcttccgcaatctgattgcatccctctcacaggaatgcatcgttctgctttccacgcatatcgtaagcgatatcgaaaccatcgcagacgatatcatcgttatgaaggaaggaaaaatcattcttcatgatacaccaaaagagctacttcatactatgaaggaaaaggtatggcaggtaacacttccgaaaaaggaggcactctcccttatggcttcccatattatcgtaaagagtcataatgtcgataatgacatcgaactgcgtattgtggctgatgattgtccacataccctggctcataatataacgcctgatctggatgatctttatttatattattttaaagaaggtgatttcctatgagacgattgattcaatctgaatttaaaaagattttcaaaagcaaaatcaacatcgtattgctgcttatcctgtttatcttcaatggctaccgcacctatcaggtttaccatcagccactgcagtaccgcactgatatcgtcatgaaggatgaaaacggaatagaaagaacaggacttgcatattggaggcttgccgatcagattcagcattcctatgcgggaaccctcagtgaaaagaccatacagcagatggataaagacttccgcgccattatgaacaagtatacagaaacaacgctggatgaagaaaaaatgaaagctgtatatggcgataattatgaaaccttactgaaagacgcacgcagcggtaagtataccggtaaggaagtcaatgaattatttgaaaactatatgcagatcagtggaggtatttcctatgaggaaatcgaaggaagcgacaaagtaaaggtacatgttgaagattatttaaaacatgacggtgtgcgccagctgtatagtaatatctatgattattatattgaggataaaaaggatgttgccgattatgaaaacttctcttctgacgcccagagaaagtggcttcatccggatcagttaagtaaggaacagcttaatattgagattgccggctttgagtatccggacagcatatacgatgccacgatggagaatttcataaaccgctataaatcagcctctcatgagattgacagcaatattccaaatacactgttcgttgaagctttgtataatctggaattcgcttcgctgcttattcttgttatcattctggcaaataccttcgccatggagaagcattataagacctatcagattatgattcccacagctgccggaaacaaaaagataactgcggcaaagctgtgtgcaggtatattgcttgcgcttggaatcgtactcatacaatttcttatcgtatatatcatgtcctgtatgttccttccactgcgtggtctgaatctgacttattattcccagtcgcaggcatcattgaatatcacagcctatgtatttacttatcgaacgctgattgtgaatgctatgctgctgatcagtatcgcatcaatggcaaccgcctttatcactatgcttttttcctatatcataaagaatcgttttgcgacagtgattccactgcttctggtgacgctgatcagcggatttacaggctttttcaatcagctttagccaggcatggtgattgatcagttctttccttctcaaatggtacatttcacacaatttttcaaagtcgcattgaatcctcatctgggtgaaatgctgccgtatttcagtattcgcggttattcgctggcctggaagaatgttattatgctgttctggatagtttcgattgtcatcatatccctgtgtatgcttcagcattcccgcaggcatgtgaagaactgcagctgataagcaatatcaattcaaatcaataatatcctttaaagcaggttacaatctgataacagtgatataagcattacataaaaatcatatggcaatctcttagcaaatgattcatttagtgacagtctatggcgttttatatgataatccagatgatccacaggcactgctgcttcaggaaagtatacagaaagagggtctttccagcgttgtagaacgcattaccggctttccaaaaacacatgaactacatcatgccatcctgcagcattatgaaagcttaaaaagaaattgatacggctggcgaaatagcactgtgacagaaaggcttatcgcccagcaatatgaaacaagcaagagaagattggaaagtattccacttgtaattgtattcgcttaatccatgaggcataagattaccagcgacaggtgattttatgctttttatttacgtaggaatcgctatgtatgcttatatactctattcgaaataagcctgatacatgtaagagtataagttcaacacattacaacgaaacatcataaaaaacctcattcctgctttactttcttagaatgaggttcaacgttttcctttttaaacctgataatactccagcagataggtctccgcttcttcacaccatacattatgatttctctcacatatatctgccagtgttttaaacaacgggttttcagactgcctgctgcggaaattttcaatcgcagtcagtggcagatcgatatgcggataaatcagttttttccctcccggtatatttggcagattcagaattgtttccggtgcagcctgcaacccaccgatatgtgtaatcatatagcttggattcagtctgttttctgcagacagcgtaaggcattccagcatatcctgcgttgatccgccagaggttcccacaatatgcgttccttcataatgcacattgtagaaattaaacggtactgcaaattgtttatcggttggtcctgcaaagaagttcagacatccatcatttcccaatactgcgtcagcctgcttcagaagtgctggtactgcggcaaatacaaacacatcatcaaagccggtgcccctgctaagctttcgcagctcacttactgcatctatatcctttgtattgatataaatcaatgttttcccctgtttctttgccgcttcttccggtatcagtgtacgtgcacgttccagacgctgctcatcgatatcagtcactacaatcagctttgatgaaaccggcccattcactgcataatcaatcgctccgattcccatcggtccggcacagcccataagcgccagctttccctgttcctttacgcccatgaaatgctcatatacatactgttttgtatgataggtcgcatggtatgctccgataatgcaggacattggttcactgagggatgcattcgcaaagtaatttccttggtaagggagtacacaccccagatcaatggcgattttcggaataatgcagtaggtggcattccctccgaaatattcatagctgtagcctgcggaataaccgcttggaagccccatcgcaggctgcagtacaaacttttcacccggctgaaatctgtctttcagatggtttcctacttccatgattatgcctgtaaactcatgaccggtaatcggcggacgctcgctgatattatccggtacacgcttgtgatcctcccccagaagcgctgccttgtacgtagacagacagatactgtttgatatattcttcaccagcagttcatcatccccgattggcggtaattccagttccctaacttgtatggtattctttccgcatagtacggcagcttttgctaacatgatatccttcccttctctagttttctgtattgctgatttcttcgaaaagcgcatccagattcggatcattcatgaaattctgaatggtgataatacggcgattaggaaatttcaagcgtgctcgatccagcagactgatgtgcgttacgataacatctgcctcatccggcaccttttcaatagcataattacgtactgttttttcaactcctattttctgaagacgcttcttgaacgctgtggcccctaacgcactgcttccaagtccggcatcacatgcaaatgcgatatatgcaatatcctttaaggcctctgcttctgtctgtaatgaagatgcaaggagatcctttccttcctgcttcatagccttggatttctcaatgctcttctccagcttttcatcaccgttatccttgtttgtctttaaaataagggaagcaagcaggaagctgatcacggtagctgttactacacctgccagaataccgatgaaatttcctcttggagtcagagccagatatgcaaatatagaacccgggctcggtccggcaaccagacctgctccgaaaaattcaaacaccatgataccgcatgcggaaccgataatcatcggaaagatcatcagcggcttcatgagcacatatgggaaataaatttcatgaataccgcctaagaaatgaataatgatcgcgcctggtgctgttttcttactgtttcccttaccgaagaaagagaaggcaagcagaagaccaagcccggcaccgggattactggcaaccataaagaagatggatttccctgcttccgcagcctgctgcattcccaaaggataatagacgccctgatcaataacattgttcaggaacagtacctttgcaggctcatttactacagataacagcggcaggaatcctgttttcacaagtgatgtaatcatactggtgatcatttcattcgcaaactcaataacaggtccgattgctgcgtaagagcaaagactcagaatcattgcgataataccaagggagaagttgttgacaaccatctcaaatccggcaggaatttttccgtcaatcagccggtcaaactgttttacacaccatgcactcagcggtcccataatcattgcgccaagaaacatatttacttcagaaccaacaatcagtccaaaggttcctacacatccagcaatcgccccacgttcgccgtgtaccagttttcccccggaataggcaagcatcattggcagcatatactttaccattggcgctaccagttcattgaagccttcgttcggtatccatcctgtagggatgaacagagccgttataaatccccatgcgataaaggcacccatattcgggatgaccatagcggtcagaaatccaccgaatgcctgcagcttcgctcgattcattttatttcctccttacaaaatctcatatcctgtgacagtctgagagtcagatccgcctgcatggaatgctgtaggacccgcgaaacatttctgccgtcactgcgttcgtaaaacgcaatcgcttcgctgcgggaaagtcctccctgtatcttccgctcaatcagacgctgtttcagcatgtcctcttcggcttgaatgaagatactgtaatcacagaactgtttcagctccttccagccttcctcctgtaacagaagccagtttccttcgagaagcagtatatccttggatatctgtatctgatcctcgacaacatcatgcagatttcgatcataaaccggccaagttatatcctgatctctgatgatacgtaaagcctctgtcagtttttttatatcaaaggtttccggacaacctttaacatcacgtaatgggatcctgattccatccttcagcatggtatgggaatcaaggtagcgctgcggataatgaaacccgtctaatccgatatcctgtatttcacaaagctgttcatcaactctggacagatgggcgagtacactagccagtgtggatttccctacagccggcggtgcagcgagaaagaccagaagccgtcgttttttctctttctgaaattcactcagcttacgaagcagcggaaggaatatcatttccatatcctcctgctcataatctgctgaaatcgtaaatccgttgattacaagcggaaaggtgactctgctcatgcaagcactctcctgatatcctctacacattccgcatgcagaaggccattcattttatcctcatccataaatacgtcaaccatatcactgagcagctgcatatgtgcatcattgtcattggcggataaagcaataatcagatgtacgatattgtcctgaggaaatgcgacaccatccttcagcttcagaatggatatatccgttttcaaagcaccgtcttccacgcgggaatgcggcatcgccacatccggcattataacgatatacggtccattcacctcaacgttgtgaatcatagcatcaatatatgatgctcgaatacttccattctccagaagcggtgcagccgccatgcgaatggcgtccttccagtcctctgctctttctgcagtctgcacatgttttcccagtaaatcagtaatcataaatggtacctccggtaacgtcctgtttctttacacccatatggtatcatgcaaaacaaaagaaatacatttgtattcggtttcattttattgtgaagaaaagtatccccaccactttctttcacataaatgtgaaaaaatctgtcgtacgaaaaatatctatatctgttataatgtgcatgaaggtgatagtatgctgtcagataaagatatagaattgctttctcttttatataataaggaagcccccatgagtattaaggatttgtcggattacttttcagtcagcgaacgcagtatccgctattatgtgaataatctaaactatgagctaaaggagcatggaatttcaattataaaaaaaatctgtacactgcaggaccgttcctatgttgaaggctttttacaggaaaagcgcccacagctgtacagtggagataccaaaaagaaattcatgctgtacactctgtgctttgagggtagtatcaacctgagtgccgtatcaagaaatcttgatatctcacgctccagtgccaaaagctatatggatgatattcgtacaactcttacaaagtatcacctggagctgttacaggagcataaaaaaggactggtgctcaccggttctgaagaaaacatacgcaagcttttactgcagctgcttatggaatatgaaaagctgccggaaacacagcagaaaattctgattgagattctttatcactggcgtactgatcttgcggaggaacaaattcataattttttacatgttatacagaaagagcttggttttgttttatctgaccatagttattctatcatgttttattcctgcctgattattttagccagaacagcagcacagcagactctgttatcctgtgataatgagtatttcctcattacatgcccggagtataaggtgattgaagcaaataaggaactgcttaagcaagacctgaatcgctatgaaacaatgcagctgtcttccctgttaattggttcaaattatgcacaaaacagtaatcttcgggaaaatgaatggtttgaacacgatttgcttgtatctaaaatcatcaatctgtacagcaaatattatcagctaaacctaaatcaggatcgtactctctatgaaagtcttttgacgcatcttcgcccgactatgtatcgcctgttgaaccatattcctgtatcagatatggattaccgcctgattcaacaacagtttcccaaggaatatgaggtgatgaagcaggtgcttacagagttgaatttctttacaggtgagcatcaggatcaggatgaaaccgctcttttgacattgcatttcaaggcagcaattaaccggtgcgaaaaaaacaatagtaagaaaaagaatattctgataatctgttcgcacggatatggaaccagcagacttctggaacagcagctgtcagatacctatgaggtgaatgttctcgattgtattccctaccattatttaaaacagtatgagctgctgcatcaggtggacatgattgtcacaacaatcaatactctgaaatattgtaacgaccttccgattcttcatgtgcatcctgtcttaagcagtgaggatattcaactgctggatgagcaactgcttgtaaagcgaaaaaagcgggttcgtatgaccgctattctggaggctgtgaaaaaatcctgcacaatccatgattatgcggagttgaagaaaaacctgagcgaggcattgcaggatttattgatacgggatgatggccgtgaccaaacactccttgatatcctgccggcagagaatatccttctgaattatcctgctgaaaactggagagatgcgatacgtacagcaggtggtctgctcgtagtaaacggttatgtggatcagcgttatcaggaacaaatgctgtattcttttgaaaattatgggtcctatatgataattgatgatggaattgctattccccacgcgaagaatgaaggaacggtcagaaaaacaggcatgaccttgttaattttaaaaaaaccggtagaatttattaatggaaaaaagcttcaggtcttcttttccttctgttctaaagataatatcgaacatctggatgctttggtcgcagtagccaacttgatcaaggaaacggattttcgacaatgtataaagagatttcataattctcttgagatagtacaatttataaagacacatacacaagaaagtatttagaataatgaaaagatgcttacaggtatcttgcaattcatcaacgctatgaattgcatatttctgtattgcatcttttttactattattctttttctgtagtagttccttttgtatgataggtcgattctccgcgtttgattcgatcacatgggcacacgttgtgcaccctataagttctctgcgttcgattttataaggcgagcgtaccagtagaaggaatcctttggtatacatttaccagtgccatttccctcgttatcgatatccacgtaaataagcccataccgcttttccatttcacagctgtttccgctgacgatatcaaatggtgaccacatggtatatgcgaagatatccgtaccctcttccattacatcctttaactcctgaatatggcgtttctgataatcaatccggtattcgtcatgtatgcagccatcacttcccaatgcctcttccacccccacaccgttctctgcaatcatcatcggtacgccgtaacgatcccaatactgtgccatcgtattgtacaatccaaccggatcgatcgtccagccccactccgtcgcctttgtgtacggattggcgcaccgatttccattttcatcaacacagtgactataataatatgcgactgccaggaaatccatggtatacgaacggatcagctcctcgtcaccatcctccatctgaatcgtgataccatgcttcttaaaccacgttttcgcatatcccgggtattctccacgcagctgtacatccgcaaagaagaaatccttcatccggtttttctcaatcgctatctttacattctgcggatcacaggtctttgcatacgtcagctgatctgccagcatcataccgacttttaacgcaggatcaagttctcttgcagccttgacgattcccgcacttgccacaaactcatgatgcaccgcctgatatttttcggcagtgaaatcctcatactcatccataaccattcccaatgagctgaaggactccccaaaaatcaggttgatctgattgattacgatccagtatgtaaccttgtccttatatcttttcaaacaggtttgtgcgaaacgctcatacagatcaatcgtccttctgccataccatccctgataatgtgttaccacctttaacggcatatcgtaatgtgtcagtgtgacgatcggctcgatgccctgtctgtgcaattcatcaaacacctcatcataaaaccgaagtcccgcttcattgggatattcatcatccgcattcggaaaaatccgtgcccagctgatactcattcgaaatgccttaaagccacactccttcatccaacctatgtattctttatatcggtgatagaaatccaccgccttatgctttggataatattgctgctgcttttctgcctgcacatctgcaatacgctgcttcaaaagctctctggtataattggtattgccgccgcctgcagcttttttataacaaatctggatatccgcaacattcaacccttttccatcctccagataggctccctccatctgaacagcagcacttgcgccaccccatagaaaaccttcaggaaacacactcatcagctttcctccttttttacaaacatagccgcaaagctgcgaaaggtatcgattagagaactgcacaattcaatttcactgttgattgtcatcagtgtgtcctgcgcatgattgaacagcatgcagtattcatactgcacaccccgtgcttcggcctgaataatttctgtctgtgccgcatgagcctgtgttatctcttttttggcttccttcaggcaggcatccgccttctcaaactgcaatgcttgtacatattttaatgcctctttggtatgcagacgggcatctccggcatgcgtcagaatccccattgcactcagtatcagctcattgttttcatcagtcatttgcttccatctccatttcttccttcaccattttattctcatgtgccttaaagaacggccaccagatcagccatgacagcaggaacatgcctacaaccagaatcacggcacggaaatcaccatgtgttgccagaaaggaacaaatcggcatcggcagctggttcacattcatgacagcatgcggaatcgtgacaagaccgctggagaacgcaaaccatgcaatcgttggcagaaccagtgcattgatccacatcggtatcattaaaatcggattcaaggcaatcggtgccccatataccagaggctcattgatattgaacagcgacggtatcatagcaatctgtccgaacttcctgattctcttactgcgggatttgagcatcatgatattcaaagccagtgtcattcccatacctccgataaagattaccgaaaaggttacatttgatgtatagatatttgtcggctgcagcccctgttcaaatgcagctgcatttgcggtgattcctgcaagaccgataggactggtgattggattcataaaccagctgttgataccaaatgaatagaagaataccggtataaagatacagagcataaagcccggataggtctgaccgatactgatcagtggtgagaacagcttggtaatgagctcaaataggtcaatattgcaccagtaaataaggatggtagtaagcacaagcacgataattcccggaataacctgattcagccagcgaatcaaaaaatccggaagagatacggaatcctcaaacagatgcagcttgaaatacagattactgatcacaatggtcacaatacccgcaaagaatgcagaaatcataccggagcctccgaatcttccaaacgctacctgaaactgaaagtccgcaatagacggtttaatcaccataaagaacatcattaaagcgattaagccggttgacacaccataatccttaaacccatattcctttgcgccgtgatagccaaccagaaaaacgagtgtcagcgacataatgccaaagctgaaattatagaccggagaaagatccggaagaaaggagacataacccgcaagcagattatatatggagataatactccccagcagcagaatcggcacattggccatcaatgccccggaaagtgtacgtattatttttttatccatggcctttgcgacctttggtgcaaagctggagcccagccagttaataaatgtattcatagctctatcccttttcctttaacgtttccatacataaagcaagcagtccttttccatccagtcctgcatacatatccttcggtatcatcagaaccggaactgcatacggaccacacatcgcctttaattcatcaaacgcataggataaatgcggcccgatgagcagaatatccgtcttcggaagatcatccgctatattgttctgactctttgcttccaccttggccatgatcccctgtttttttgctgcaccgcgcatctgctgtgccagaaagccgctggacatccctgctccgcagcataataatatattcagtttttccatcttttctacctcctgttggtactggaactgttccacgcctatattatctccggtataaagaaaatgctcaacttgtaatctttccttgcaggggtgaaagtttttatattttcatccctgtagtgaaaaagattcgttttgctttgtttacttcttgcattataataacagtaaagagagaggtatgcgtatgaaaaagaaacatgaggagcttgtccatataataagacagcagaaacagccgatttcttccacacagcttgccagactgcttaatgttactccgcgatcggtaaaaaactacgttgccgccatacaggaggaatttcctgatctgattgcggcaggtcccagaggataccgtattgatacagatacgcatgtgaaagcagaaagtgatattccgcagacataccaggagcgcagctcttatatcatccggcagtttttcattgaccacgcgcaggaaatcgatctgtatgatctttgcgatgaactgtatttgagctattcatccataaaagggttgctgaatcgcatgaacaaagagtatcaggataccggaatcacctttcgatgccgtaatgatatgatatatgcggacggggaggaaagacataaacgaaaatttctgacagacatcatttatcaggagtctagtgaacgctttgtggatttacagacattgaaggatatattcccggatttgaatgtccagcagattcatgatatcctgcatgagacattcaagaagcacagctgctatatcaatgacttcggatatacaaatctgacactgcatcttgccatactacttgaccgtatgcaaagcggcaatacgattgagcattcacaaaaggagcagcctgagctttcagaaattacggtgtctgtgatagacgaattagaaaaaagctttcatgttgccttactggatccagaacgctgtgatattcacaaccttgtcaccaccagcatcaacctctgccatgcggaaagccgacaggagctgattaccgttgtcggacaggatatctatgaaatcacacagaccgttatatcctcagtcaaccggcagtatggtttacagctcgataaggatacgctgctgtatccgcttgctctgcatttcaagaatttatttgcccgctgtaagagaaacacctcattgcgcaacccgctgctggaaagcattcaggcctcctgcccaatgctgttcgactgcgcaatctatgtcgcaaattatctggaggcttcctgtaatctccacatcactgcagatgaaaccgcttatcttgcaatgcacatcggtgccgatatcgaacggcagagcagcgacagcggaaagctgaaatgcgtactgctgtgtccggattatcaaaatagcaggcaggaaatctataattatcttctcattcattttgattctgaaatctgtatcagtgctgcatgctcctatgaagcacagctgccggatacagcaatcgacctgttgtttaccacaattcccgtacaaaaagagtatccgcatatgctgatgattcctccattgaaaaaagcaatggatcttaagcagatattcgaaaaaatacaggaggttatggatcagaaaaagctgcatatcctctctgagagcttttctgacttttttcatgaatcgcttttctatctgcatacagatgccggtttgaaaaaagaacagataatccgtatcctccacgataagctctatgcacagggctatacctctccatccttttatgaggatgtaatcaagcgggaggaggccgcttccacagcctttggatgcatcgccgttcctcattccatgaaaatggacgccagaaggaccggcatagctctcgccctgtcgaagcagggtatcacttgggacaagcagattgttcatgttgtcctgttgatcgccatacacgaacaggagtcacatttattcagaaagctgtatgaagccctgattctgctgttctctcagaagcatgtacccgatcagatcaaggaatgtataagctttcaggagtttaggcagctgttgcttactctgacagattaacagctcctacatatactcatccttaccggctgaacagctctagtgacagactgccttccggaaaaaggatgacttttttatttacattccttctgcttatttgcttgtttatgctcatttttaacatctatatccataataaatcgtacattttcgataatattcgtgcaatagtgcttgtaatgctcttcctattctcgtataataaagctatgaacgaatatgctgactacagtttgcataccgcaccagacacacacatacataaggataaatacctctgataagccataaagataggagttgaacagacatgctgtcagctgaaagaaagctgtatattctaaaaaaactggaatcggaacagacgatacaggtaaaacaggttgccaaagagctgcatgtatcggaatcctccatacgccgagaccttcttgagctggatgatgaaaataaggttgacagaatttacgggggcgctgtaaaaaaagaacgggaacgcattctgacagatgaagcggaaataaaaatgatggaacgcatgtccattcattatgataagaagctgcggatttgtaaagctgccagcacactggtagaggatggggagtgtgtttttctggatggtggtaccagtattgtaccgatgattcactttctaagcagcagaccgattaaaattgtgacaaacaatcacctaatcgtacagaatgttcagaatccaaaggctaaaatcattgtcatcggtggagaattcaatacgaagtatcgaatgagtgagggcaatgaagctcaaaatatgctgcgtctctataattttgaccgtgcctttatcggctgtgccggagttagtttgggcatgaagaaggcttttacagccgagatggccacaagagagctgaagcgtatcgctatggaattatcaaatcataattatcttctgatcgatgacagcaagctgcacgtaaagggcttttgtacgtttgctcagctggatgaatttgaagatgtttttatcaatcgcacgacaggaatggaaacacttccggatcatttcattgctgtcaaatagcagctgtactgcaccatttccatacaacagcaaagagtagtcctatatggatgctccacaagcagttcatcatccggcttatattgcaggaatacatcatttcattacatatattcatatctaaaaaagctttaagctttatcgaagagtctgaaccgtttatctcccggaggctttgaactatccatcatactgtactaaaaaatcatcgaagcagtatcgatgattttttatatgatagcagctcttccaaagggagattacaaacatgacagtcgctgtcttggaaaaggagatgtctgtatttcagaaggaagctgcatcatatttaattacatacatttatccatcagggatgcaacaattcctctctttatctgtctttcttaatatgacagacccggatcaaagaatccaaccagaactccggcaacagcaatcacaaccatgagtagcatgatcttgatcgggctgattccttttttcgccatcagccaccagcagcccataacaaacagcagagtcagaacgccgggaaatgcaccatcgagcttttcctgcagtagtacaggtacttcctgagttcctgtaaccttttcgataactttagagccttcaatgaccatctctgttttattctgaatagaagttgtcagctgtacagccgttgtaattgaaacccaggtgccggccatggcacctacgattacctgacccattacaatgacagattcacgcaatgcagttgcctgttcgccgacaattacctccacagctgaaccgccaagctcatagccctttccataaatccatttctgaaataaaatacttgtgatattccatacgataatatagaacagaggaccaatcagtgagccaccctctgaaagccccaatgcgatacccagcagtaccggaatataggtgccgacaatcaaagagtcaccaatgcctgcaagaggtcccatcaaaccggcgcgaataccattgatcatctcatcatcaatttcttcagcaccgttcgcacgtgcttcttccagaccagcagttatgccgacaacaatggaaccaatctgcggctccgtgttgaagaatgggtaataggtcttcagcttttcagcctgctcatccttggagtcatacagttcctgaacgattggcagcatggaccacatataaccgaaggtctgcatgtgctcatgagagaagcatgttagatttccgtaaaaccagcgccagaaggatttggataaaacttttttcgaaagcttcttcatatcagatatcctcctcttcatttgtatttgtctttgcacctctcaaacgaatcatcgtcatctgataattgatcagtgcgaatacagcaccgactgcagttgccgcaatcagagttaaatgcatggatgccgcaaccgtgaagccaaacaggaagaaaatcaaatcggttgctttgcttacgacagatttcagcagtattgcaatccctaccgcaggcagtaagctgccgatagtaaacagcgatttcatataccaggaatccattggcaacgccgttttaaaatctgtaacagctccagcaccataataggtaatcagcatgaccggaataaaggatacaagaatatgcgaaatcagcggaagtatcacattgacctttgttatgataccaaaatcctttttatcaagtcttgcccatccgatatgctgccagacaagattcatcatagcagttccataaaactgtaccgtgccgaccgtacctaccagtgcaccaatggatccggcaagtcccagtgcttccggaccgccaagatcaagcccctgtgatttcgctgttgcataggcaagcgggataccgatatacgatactgcacgaagatcggcagcaacggttcctccaggtgttacaactgcgatatagataatctgcataggaatagccagtttgatacagccctctacatcacccaatgtcaacccgacaaataatgaggcaatcaacggacgatttaatgtatagttaccaatcgtcgtacccagtgcggcagggatggacgctgctgtacagctcattagacccagcagtgcagcctgtacccaagtaatcataacttcatctccttttctctgcataaagcagctcaacagcaagtcatcctttctcacatttcacggcccctaccccttggaaaatcagacctgctgtaattacaaggatattatatttatttgtataatcgtttacaaaactataaatagcaatatacttataaatgacacgcgtcctttttattatttgcacattcttgcacgtttgacagcattgcagttacaattctgcttattcaaagcagaaaaatgtttgttattataaaataatatattcgaaactgtgattttatttggtattttccatatttagcaagcttttgtttcttgtttatctcatattctgattagtttactgtttttcaaaggaaaaccattcatttctctaaatcgatacgaatacatagcagctcttcttgtaagcagccattttgttttaaaggattcgtatatcgatcagcaattgcatagatacaattgtatgttcttttataatattcaggtatgcagtacgacatctttcatactttacaaccatacatacattcacagtacagctaatataacattttatgtacaatatgtatgagagttaccacacagctttccggtatcgtactgctgataatatttccacagtaaaaaaagaggcatccctatttgcctctttactatattcttcgcttcttatccgatattagtaattatctgtggaaaccttattatccagacctaaaactaccggtacagacttgtatccaacacccatgcgatcgattcccatatcgatcagctgcaggaaatgttctctggtacgaatgcatccgcttcccttaaccttacatttaccgtcaacctcttccatcataaccttaatgatttccggtgttgctccgtgtgattcaaagcctgtaaggaatccggtgctggtttttacaaaatctgcccctgcatcgatacagcatttgcatgctttacgcacctgttcctcattgagagcatctgtttcaaaaatcaccttgatttctctgccatatttatgagcagcatccgcacatgctttcagatccttcgtgacttcatcaaacttaccggaacggatcagaccgaaattagcaacgatatccacttcttttacagtatcgtattttgctacgatttcaatctgcttcactttagattctgttgagctcgtcccgaatgggaagtcacataccggacacagcattgtttcgcttcccttaacatatggttcacaaagatccatatatcctggattgatacagattgtagcacagcccagctcgacgccgtcttttgtaagagcaatgatatcctcctctgtaaattcaggttttaatacggaataatcaatatactgtgcaagctcctttgtcgtcatttcacatgctttttttgttggtttcattttgtcaccttttacaccatagtgccctttcttacaatctaattataaggctgcagcgaaacaaaatcaagcattttcattcatttttatatatactataaatgaatttgaatgtttttgctcattttaaccagtatttcttatcaacaggtagattaacaaacaattatattttctatatacaataatcacaagcctacacgcaggattccaggtgcgatagaatcataaggaagatgctgaacctgaagagtcgcgtttatcgctatgcataagaaggcagtgccccaacaccaatagtgctataaaatcacggcttagaaataagctgtatatcgcataaaaaaacacggatctatgccgtgttttcttaatgactttctcttagtagtttttagcttcttcagcaaagtgagctccggagtatccacataccggacatgcctttggtgctgcagttccttcgtgacggtatccacagatatcacatacccatacagtagcttcatctttctcaaatactttaccgttcttcacgttttccagcagcttcaggtaacgttcttcgtggtgtttttcgattttagcaacctgctccatctggaatgcgattttagcaaagccttcttcttttgcagtttccgcaaatcccttgtacatgtcagtccactcatagttttcaccagcagctgcatcctccagattaactgcagttgtaggaaccttatcctcatgcagagccttgaaccacagctttgcgtgctcctgctcattgcgtgcagtttcttcaaagatatcagcgatctgctccataccttcttcacgagccatctgtgcgtaatatgtgtatttgttacgtgcctgagattcaccggcgaatgctgccattaagttctgttctgtcttagatccttttaatttcatgtttttttcctccgtttttaactttacattttctgatcagtgttcctgatccataccattctgctttttcaagcaatcctggcagataccctctgccatcatattgtgtgtcttgattggaagtccagtctgttttgacatttcctcgttgaatgactcaagataaggaatatccaaatcaaggatgcggtcgcacttaatacagtgcaggtgatagtgcggtttacaagttttatcgtactgataaccatctataggatgcgcaatctttttgacttcatgcatctcacagagaatattcagatttcgataaatcgttgccagactgattttctggccgccggcattcatttcctgaaagacctgctccggtgtgacatgaccatctatctgtttcatatagtttagtatcatatcacgctgcttggaagactttcttatcatgtcaacctccaatcttaagaaccgttcttattatatacccgaaaagtgaatccgtcaatagttttaagaataaaattaaaaataattcttagttttatcattggaaggaaaagcggttatgcaatgccttcctttttatgcagcagtaccacacactgtgcctgcacaccttcctcacgaccgacgaagcccagcttttccccgcgtgttgccttgatgctaacctgttccatatcacagcacagtgcctctgcgacatgctttctcattgccggaatatgcggagccattttgggtcgttcaatcatgatcatggcatccagattaccgattgcatatcccttttcctccataatcttatatacctgcctcagcatccacaaagaattcatatccttatatctttcatccgtatccgggaaatgctttcccaaatcccccagcgccagcgcccccagaatactctccgctattgcatgcagcagcgcatccgcatcggaatgcccaagcagtcccatctcatgttcaatttccacacctcccagaatcagctttcttccttttaccagctgatgtatatctgtagattgcccgattcgtatcatacagacacctccttcttatatttatatagtgtatcgcagatttccggaagacgcaattcatccgtgtttatttcatagggaaacacagttagtttgtatttcttacttttttgtaatttgtagaaaaatactacaaaatgaaagaaccttatggtattattaaactataataaaaatagtaagggagagaaacaaatgaaaaaattagccgcactggtattaagttttggtatgctgttttccatggctgcctgctccggttccaaggtaagtgacgacgcactggataagctggaatcctcggtaaagaaattcagcgaggtaaaaaatgcgaattactctgcagatatggatatgactgtagataaggaaaatgcaaagattaagctgtatggtggttttatttcagaaacaaagaagcctctgcagttgagcatgatcatggatatggaagcaagtggacagaagctggagaaatacatgcagctgtttgttaaggacgataccatgtacctgaacatgatggatatgatgaaacagaaaacaagtctgaaggatgcaatgggtactgcaagtattccaaatgtaaattttgatgcggatacctttaaaatgaacaaggaagacatgaagaaattcctgaaggaagcatctgtaaagggaaacgacctgaagctttccttcgatgttgaaaagctgaacgaggaaacaaagaaagaaacagagaaaaacaatgttacggatgcgaatgtagaattcaagaagctggatatggatgtcacattgaacaatgacttcatggagaaagctgtcattaccctggagatgacaaataccaagggtgagaccaagcaggaaatgaatggtacgatatctctgaccgtaaaggatatcaacaaggtttccagcattgatttcccggacttcaaggattataaggaaggcagcatagaataacatgtaacggccgttgaactcttagcttcgcggcctttttctaaatagaaaagggagatgagaaaattgaaaaaaatactggcgatactgacctgtgcactgatgggtttcacacttgcagcatgcagcagtaagaacaaaataaatgaggatgcactggatgcgtatgcgaaggcagcaacaaacattacaaagatgaaatccgcagcctatgatatgaaactgctcgttgatgcagatgatatggatatgcatgccaaggttaccatggacggaacgtataatgcggaaaagaagctgcagctggctttgcacatggatgccgctgtaaatggaatcggactcgatgatcttgcatcattttatatgaaggatgatgttgtgtatgcaaacatcatggagatggaaaaggaatacaatgaattggatgatcagctgctgaacaagctgaagcttgataaggaaaccggtgatccgaaaaagaatgttgaaaagagctttgaagaaatgacgatggaggaaaaggatggcagaaaagtcatcacggctgtcatgaataaagacggtctgagtgccgcaaaggattatgctaataaatccattgatgatgatatctttaaactcgggaatggcattaaagtcaccggtatacgtgaaggctcctatattttcacagtgaataaccagaatcagtttgagcgtatagaaatgaaggtcgcagcgtcctatgaactggacgatgaggacgaaaaaaagaaagcagttgatatgacgatcagcctcgtagtgaatctgaacgatatcaatcaagtaaataaaattgattttccatcctttaaagactacaaaaaggcagatagcaggaaatcggaagcaaatgacctgctaaatgaattaagtaatgaaaatgcactttgatatattgcattttacatttatttctgatatgatgtacaggcttataagggagtagttagctcacatttgagtagttaggtcaacataatgattcacagtgaatctggcttaagtattaaataacgagacttatgcgtgtgtttttcacgtatgagtctctttttcattcaggaggataagggtatgagtttattttctatttttatgatcggtatcgggctgagtatggatgcatttgcggtcagcatcgcaagaggtatgacaatgaagaaagaagatcttctgcgttatgcactcacgctgggttttttctttggtgttttccaggctgttatgccattgatcggctggtgggcaggaagctattttcaggagttcatcgcttccatcgaccactggattgcatttggtctactggccatcatcggagggaacatgatacgggagtcccttcgtggagaagaagaggcctgtgaagataaatctctgactttaaaaaccattctgattctggctgtagcgaccagcattgatgcacttgctgtcggtatcagctttgcatttctacaggtacatatctggacagcgattacagttattggtgttacaacctttgtgctcagcttcatcgccgtctatcttggaaaccgccttggtgatcttttagagaaatatgccggcattctgggaggtatcattctgatactgattggtacaaagattcttctggagcatctgtttgggtagaaatacctgttgatgctcccttttctatgattttatgataaaattatacgtacatgaatggaggaatgtatatgaagcagccactggcttttcggatgcggccgcagcatctggatgatatcatcggacagcagcacctgattggtgaaggcaaagttcttcgcagatgtgttcttgaaaagcgcttattctccatgattttctatggacctcccggtaccggtaaaacaacactggctatggtgctcgcaaacgagctggagcttccgtttcgcatgtttaatgcagtaaccggaaataagaaggatctggaaaccatatttcaggaggcaaagttttacgagggactgatcgtgatcattgatgaggtgcatcggttgaacaaggataagcaggaccttctgctcccacatgtggaaaacggtaatatcaccctgatcggcgcaaccaccagcaatccgctgcatgccatcaatcccgccatccgttcccgctgtcatctgtttgaaatcaagcaggcgcagcaggaggatatcgaacaggctctgatgaaagccattcatcatcaggacggcctcaatgacagtgttcagattgaggaggaagcactgcatatcatagcgcgtcacagcaatggagatatacgatattcactcaacattcttgaaatctgtgcacttgcaagtgacggtgtcatcacacaggagcttgtttcacaatattcccagtttccgaatatgagcatggacaacgatggagacggttattatgatgtattaagcggattccagaaatccattcggggaagtgatgtagatgctgccctgtattatctgggtatcatgatcgaggcaaatgatatggacagtatcgagcgtagactgctcgttaccgcatatgaagatatcggtctgggaaatcctgcagcagtggcacggtgtgcaacggcaattgatgccgcaaaacgagtaggctttccggaggcccgtattatcctggccgcagccgtgatagatctgactctatcgccaaagtcaaagagtgcagagcatgcaatcgatgcagcaatgagtacactgcgccatacctcctacagtgtcccggattatcttcgatttacaccggtcaatatggatgatgatgaaaaatatgattatgaacgtagtgatctatggaatcgtatccagtatctgccggacagattgaaaaacaagcatttctatgaaccggagctgacatcctcctacgaaaaaatactggcgcagaatctggaaaagctgcgcaaggtaccacgtacgagcaatctgaaagcattgaaaaagcaaaacagtcgataatggcaatagtattgttatcctcacgaagctgttctgcatagttcttactttcttctgcagaatgcaacatctaatacttaaagcaatcctcctgcattcccatatgcaatacgctagccagctgccgcaatgagatcatcagatttatatgtcattttgaaaaagggtgaaattcatctttttttgatatcccatcagcaagaagcaggcagccgccaataatttaaaaggtagaaggcaggctgtcagaatatacttcagcataaaaaaacgatataatccctgttatatcgcagtacgcattctttccctcaataatctaatactagtcaaaatatttcagatagtgtttcaggtcgctgtgactcttgaatccatgctgactcagcagcttgaaaagattttttcttctgacattcgcagtcatacgaagaccgcaatatccgttttttcgtactctggcctcaaatacatcataaatctgacgcacctcttcattgtccgcgtaatcatcactgactaccagagccacaatattgaccagcttatctgaatacagtgtttcataaggcgatccgtgaatataaccaacaactctgccttcatcctccgcaacggtgataaagtcacttcccgtttccagtatggaaatgatacgctcatacaccttatcctcatcataggaataccccagcttttcattcagtgcatggatgtccttataatcttccggtttgattcttctaaactccatagcaatgctcctttccatttcagctttagtctatcatagaattgccgtgattgtaacagtttctaatacaattcttgccacatttctcacctttataccgcatgtataaatatttgttctctggggatgctgtaagtgttgaagctgccgcatgcagtttacgatgacaacagctactatatgaaagaaaggcagatgatatgacatggtacttttaatattcgccgccgcaggaatacttttactgttctatttgtttacaagaaaaagcgaacagccggttcagaaggtaaatattcaggcagatatacagcatgatgaagaagcagagatatttctggccggcgggtgcttctggggtgtacagaaattcttatcctcccttgaaggcgtccgcttcacggagtgcggatatgcgaacggaacgagtgataatccaagctatgaggatgtctgtacaaaggatacgggctttgcggagtgcgtacatgtcctgtatgataaaaacgtgcttacgctggaggagcttttgaatcagttttacaccatcatcgacccggtatccgtaaatcgtcagggaaatgataccggctctcagtatcgcaccggtatttattataccaatccaaaggatgccgatgttatacagcagtctttggacaagcttcagaaatcctatgatcagccgcttgctgttgaatatcagtctcttgaaaatttctattccgcagagacctgtcatcaggattatctggataagcatccggatggttactgtcatatacccgcctggaaatttgaaaggaaggaagcggcagagccccaccgtttcccgttgccggagaagcaggagctaaagcagagactgagtgcagagcaatttgcagtaacacaggaaaacgcgacagagcgaccttatcgaaatgcttactgggacacctttgaaaaaggaatctatgtcgatattgtcagtggagaaccgctatttctttctacggataagtttgtttccggttgcggatggcctagctttaccagaccgattcagaaagacctgataaaagaaaaaagtgatataagtggaggtatgcgtcgaacagaggtacgcagtgcacattccgacgcgcatttgggacatgtgtttgatgatggtccgcagcattgcggtgggatgcgttactgtatcaacagtgcggcattgatgtttattcccatctctgagatggaggaaaagggatatggtgattatctggcgcttatacagcaggaaaaccagcagtctgctgaatgaggtatgcatttttcgcacgatacaaaaaagaacaggagagtatgcttacgttcaaaatcggaataaggtaattctaggctatcagtcactattagaattaccttttttataatatccgagagtgaatcagagcctgcttcatgttctttttctaaatgtatgttcacatacctgttcgttttttcgctgtttcttttctacagtgttgttccttatactttcaaccgctttcatcagaaaaatgaaaccgcttatatttataaattacggttttcgcaatcacctgtaagaaagtttatttatagaaattactttgataaccatagctggaaacataccatttcatacagcagcaactagaaatcatatataatataaaataattttatgcagtccgtctccgcttatatttcctatgcgcgttcctttattataattttttatcactgcaattcatcgcagtcatgcccagctcaagtcattttatcaggcgtcgtaagcaatcatttctttatcctcacattgcctttcacatttctcttgtcatttttctcgcccgaacaatcagaaagcttggtttgataaactcttttatcatacccggacattcctgcagcgcatgttcatccggcagcgtttccaccatatcttctacaaaaaaaccagtgtgtgcaagcgtggtgatgatggttcccatcatgcgatgatagttttccacattgtcgacataccagaagccacttctctttccttcccttccataatcagaaaaggtataggaaatacaatctccatgctcatcgtgattatagtgaccctttccatcataggtcgcagttataattggatgctcctgtgaaaacagaaggatgccacccggtcgtaacagcttataaatatcatgtaccagggcagggaaatcttcagcataatgaaaggctagagagctgtacacaagatcatagctattgtttaaggtgccaagctccgccatatccattcgcatatatgtaattacaggatgtgcatagtttcttcttgcttctttcagcattttttctgagatatcgatcccggttacatgtgcagcgccgttttctgcaaaatgaagacagttatgcccataaccacatccgatatccaatattgccttacctttactatccggcatcagcttctgcatctttggctgctccataaaatcattatagtttttcctatgcagacgtaaatccatatacgcagaaaaaaattcatcattatcgaaaatattttgcgtcatttcacattcctccttctttcctctatgatttttcgtgaccgctccgcctgttttttcaaaatgccgtttttttctgcatatgcctgaacaaacgcttcacttttttcacaggaaaaggcagacatgcaaagaagcagcttccacagaatcaaagagtctttcttccatttttcagtcagctgcaaaagtgaatcacagatttgtggtgaagcgacatccgggtgataaaaggccataaaccctatagcgtccaaagcctcacttacttttgctttatcgtcaccttctgtaacagctactaaaacagaggctgtacatggattcatttttcccatacagcgcgctataatatcccgcggaagtggataggatttttttgcggatactgtctcgggaactgttttatactggtttgtccctatccttcccagatacagagccattttttcagctgttctttgattacctgcctcaagcgtttcacaaattgctatccgcgtgtataagcacttctccttttccagctgctgaagaagctcatcagcagcctgctccacatcttttttcagactgattgctgcggcacttcttatccatgccgcttcatgtgatagcaaaagtatacgcttcttcacttccaaggatgacagctcttctatatcatccgatgatgcctttccccgctttcgcaattgctcctctgtacttttcatacacataccccttcgataaaaagacactgtacagtgtctttcagcctatttgtttttatatttttttgaagtttccgtacttacaaccgtataagtaaacatcttatagttgtaaatggtttttgtatattcgattggattattattcaaatcatacgccgtattataaacaatcagagcaggacctgactttgcctgcaacagaatatgtgcgtcttcaccgcgaatgctgtctgcccgaatgtcatctcttgcccatgataaatccaggtgataatgctcatagaaaacatcatataaagaaaagctttcaaagttgaacatttcaagacccggacagtataatgcattgatatgcgcatattctacagcgattgcttcatcattcgcataacggatcctatgcagaaaatagacttcatccgtttccttcagattcattgcctcacgtatatgctcatccggttttatcctttccagatgcagcaccttactatggcatttcaatccttttcgctccatgagttctgtaacgcccagtatttccttgcttctttgaatcatcaaatccattacaaacgcaccacggccacgatcaatgcgtaccactccctgctgctccagcttttgcagggcatgtcggatggtcattctgcttgcgccaaagcgctcctgcagctcccgctcaacgggcagtttatctccctgcttatatatttcctgtcgtatttcctgatgaatcgcatctgcaatttccaaatatttaggcttactctctttcatttacctcacctcattgtatgttaatcctattataacaaataaatcagtatttgtatgtaccttacaggataatatatcttgagtagcaattgtctatacaaaacatccttcatagtgtatatttatttcctatcagcaaagacatcatactcactttacagtatggaaaaaggccccatcacacaccgattggacctaaagaagcttctctcacatcacattgcaagaaccttattccatttttcttcaataacaggaatcccgtttttcctatgctcctccatcgtttgccactccggttcacccggatataaaacaggccttgcttcatcgatcggcttggatgccttgatataagcgaggataccatccacaatggcatcggtctgctcttcagtatttgccttcgacgggtctatagcaatcatcatctgagatagtcctatctcatcttcaaaggtcccgattgtatgcaccgcattcccggctgtcagcacacttgcgatcatatccagtgcaatcgaaatcccgctccccttccagaagcccatgggcagcactctttttgttttgtatatttcaccgggattccttgtaatctgtccgcttgtatcatatccgccaggcaccggaagctgcaagcccttcagcctgtaatcctctaactttccataggagaactgagacattgcacagtcgattacaacatgttgcccattgctgcgcggaattgcaaataccagtggattatttccgattctctgatcctcaccaccccatgcaggcatattcggctttgtatttgaccagcagataccgatgcacccggcatccgctgcctgaaacccatagctcccaccacgcatccagtgattgttattggccagtgctaccataccaatgccatactgctttgccagctcacaggctctttccatagcctgtctggcattcaggggaccaaaaccgcgatgtccgttccagcgttcatacgctccaagctgtagctcacaggttgccttgatatcaggatctatttctcccttctccaaatactccacaacctttggaaaacgatttaatccatgcgaatagacccctgccagactattctgtgcaaagattgccgcagcagcctctgctctgtcctcctgaaaccccttcttcattaacacacgtttgaatatctgcagcattgtatcataacttacacgcataataagtacattcctcctcacagtattttttatttgcttcgtttcctgatttccatctgacaatggttctatgtactcgctctatgttcttagttgctcttaaacgagcacggctgtcagcccatgatgatttcctttagctgatctccttcatatttatagaaatccttaaggatacgcaaatctgttcccagtgcaaaatcacgaacgccaagctcataataataggccgcatccgctgcattccgtatttctacacggatgcgttttccatatcgaagtgctgtttcgattacatatttttcaacctctttgacctcatccggatgtacgcttttgtcaaacccggaattcatggagaaatcagcaggaccgaactgcaggaaatcgacctcctccacctgacaaatctcttccagattgtgtactgcctcaaccttttctatcataaagcccttaacgatatcacaaacatcccgtgcgtaatccatctgactggacagattggcattgcgtatccagcgtctgttcacaaagccaagagcgcctccatccggtgtagccggtgtaatttgccggatggtctctctcacctctgccgctgttgtatgatcggtgaacaggattccctcaaaaccggatgccatagccttttgcgccacatatatacgattgtgatagtccggctttataatcatggaaatattgtgcagctctgctgcgcgtgccatgttctccaggtcgtaatggtcaaatggggcatattccgccaggaattccacataatcatacagctcgttgctgccgatgatttcaataagctgcggccatgtaaaatcgatacgggttgcgacgataacttctttttccattaatttctttcttaactgatttatcatattgtttttcctttcctgcagagctcttctgctatcgttactttttgattctttaacactgtgtgcgatatccctgctgtcatggtaatcagacgcatcagctggtaaccggtttcctccagatattcctctgtatgtgccagtgcctcatggagtggatagattccctgctgtatggtgaaaatgccttggaaatatgtagtaagtgctatacaatccacttccctctgcccgcatacggcaagcacaggaatgccttccttcttcgctgcctgcgcaatacgtatcggaagctttccctgcagggtctgatgattcatctgtccctctcccgtaatcaccagatctgctgtatgcagtctttgctccagacggacataacggttgatcagctcatagccaaaggttaattccgcaccgagtatgtacagccctgcagcacagccgccacctgcaccgccgccttcctgcataagatttcttgcgcttcgctgctccagtagatgaagctgctgttccagcttgttcatctgcatggcatttgcccccttctgtgcagaataggtaagcacacagccctcttttccatacagtggtgcacaaacatcacagcctacaagaagcttcatatcaccgagcttctttcttacggtctgaaaggcttcttcatcccagtgatcaaaagcaaacagaggattgcaatcgtcaggcagcacatttcccatttggtcatacagcctgatgcccagtccctgcataacaccaagaccaccatcggttgtgattgttccgccgagaaacagcagtaccttgtgaatcgcatggccgtgcagctgattaagaagctcaccgagtccataggttgatgcagtggcagcagtggcactggaaacctcgcagttatgcagcccgaagatatccgcggcctccacagcacagcacaggctttccccctctttaaacagcagtgtgcgcacggttattcgttgatgaaaggcatcccggcattgccaagtcctgtattccccctttacacaggctgccagtgcatggacgctgccctctcctccatccgctacactgcaaaccgtcgtctgatgtccgcttgtccgcaagattcctctttccagagcctttcctgctcgttcagaggacagcgcgcctttgaatgaatccatcgctattagaacgttcatgttcatctcctttccccttacaatataattctaatatgcagataggaataatcatatgtgttataatacaaatataaccatgattttattacatatttttgtgatatagaacaggagaacttatgaaaatttctgaagagctagcaaagattatcgttgataatatccatgaagtcatccctgaggaaatcaatttcataaatgcggacggtctgattatcgccagtacagatccaaagcgtatgcatcgtctgcataccggcgcgctcagtgttattcgaaaccgcgagcagctgagcgtgcaaaacgatacacaatattacggtgcacgtaagggaatcaatatgccggtattctttgatgatgaaattatcggtgtgattggcattacaggtgaggaacaggatgttatcggctatgcgaaaatcctgcagaagatgacacagattcttgtcaaggatgcatattatcgtgacatccgtcatcagaagcgttccagtgacaggattctgattgagcgtgtgctgagcgggaattttgagaatgaatccttatttcaaaatgacaatctgacacaaaggagtccaagactgattgtatgtgcaaagattgacggacagctgaaggatgagcagatcgaccgtatacaccgtctgctggaggctattcccttttccacctatattgagaaaaaggcgttgtatgtgcaggagctgattttcattatccctgcacagaacaggatgtatatccatcagtggatcggaagtatccgggagatatgtccgcatgcgattttctggggaatcggcactgtgactgagaaaatcagcgatttgccgctttcgtatagcagagcaaaaacagctgccctctggggcagcgggatcagcgggcacagggtttcctgttatgaggatatcggggtcggtatgctgctgccgcatatcgatgagttggagagagcatatttcctgaagcatctattcaaggattgcagtgctgagcgaattgcggaaatcatgatggttttatccctgtacgaggagcataacggcagcattcttcattgtgcaaaagcctgcaatatgcatcggaactcctttcagtataagcttctgcaaatacgcaagcagaccggtctggatccgagaagccttcatgattatgtgctgctgaagcttgctgttgtgctgtaccaatttcagcaaaatacaccgcattcctaaacgaaaacctgttcatgcaaatgatatttatgagaaaagcacgccttgactctttggagttcctgcgtgcttttattcttgtgggtaatctgttcatatctttatattcacttctggttcgattatcacaggtgaaagtcttatcatacttaatctataatcaacaggcttatatgctgtttaaagctaccgcttgaacatccctattgattggataattctccagagtattacacagaataatacgattttcaatctgatatagcgacgatttcaactgatcaaatccctttgcatcacttgcttgaaaagaaacaccctgttttatttctatgagtgaaagccttcctttataaagaaggacaaggtcaatttcattttgtttactatcccgataataatatgcatgaaacggctccttattatttaaaaaggtttttcttatttcattcactacaaatgtttcaaaaaaagcaccggataaattggaaatacgcagagtttcgggataattcatctttatcaggtaagctgcaagacctgtgtcactgaaatacaccttacttgattttacaacacgcttcgttatggatatatcattatacggttgtagaaaatatatcaaaccggtagattccaatatagaaagccaatgctgtatcgtgttactgcttacttgcagttttctgctcaggtcagaagcattgatctgctgacctgtaagagcagcaagatattgaaggaaatcatgaaatttcagcttatcctttaggtgtatcagttcactgatatctctgtcaatgtacgtattcacataattctcataatagtcaggcaccgcttgatctgtccgatataattccggatacataccctttgtaatcagttcaaatacatcttttacacttatttttatacttttctgatacattgctatgcgatcttttgaaggtacaaacggtaaagtttctctacccagaatttcatccagccccagaggcaccatttgaataacactggctcttcctgcaagggactgtgttacatttttcattaaatgaaacgcctgtgatcctgttaacagatacattccattggcattaccagtttccagtctctttctgtttacaatttcttctatcacttcaaataaaaccggagcatactgcacttcatctatgatcagcggcgtgtcaaactgctgtaggaaatacttaggatcagaaattgcaagctttctttgatcaatattatcaagtgacacgtacgcaaagcccttttctttcacgaactcataagcaagtgtagatttccccacctgccttgatccggttaaaattacaacaggatacatatccaaagcttttactacatgtggttttatagcccttttcaacatgaacagtcacctcgtttcgcacgtattttaagttcaacttcataataacactaatttcttcttttttcaaatataaaaaatccgtatgaaaagctccttttcaagtatacccatgaaagagtcctgtcatcaccattctctttcctgttgctttattatatgaaaaggactggttccatcgcttgaaccaatcccttttcatctttataagaaattatttttgatcttagtagtaatatttcactttgtcattcgatttgaacagacgaatcttttcctcaacgacttttccacatacttccattgcttccggatagatttccagaggttcacgataacctggattttcattcagagtcttgcggcactgtgtatagaatgcaaccttgatatcactggagatattgattttacaaatgccattatcaactgctgctgcaatctcttcgtctttattgctggatccgccgtgcagtaccagtggtacatccaccttgctggtaatgtctttcagaatatcaatacgcagctccggtttcatatcctttggataaattccgtgagctgtaccgatagctacggcaaaggtatcaattcctgtgtcctcaatgaactgctttgcttcttcaggaaccgtatagataacaccctgtgttccgccctcaattgaattaccggttgtaccgatggttcctaattctgactcaacggatacattggcgatatgtgcggtttccactacttttttcgtaactgcaacattttcctcataaggcagtgtggatgcatcaatcataacagatgtcatacctgcacggatggcgcgtactgctgtttcataggaatccccgtgatccagatggatacatacaggcacatcggtctgtgctgcttcataaatcatagcctgaatctgtgcatctcctacaaagttaaattcatccggactcatttccagaataaccggtgaatttaattcctttacttttttcataacaacctttaacagctgatcgcttccgatgttgaatgcaggtattgcaaaatgatttttctgtgcaactgcaagtaaatccttcatattcattaacataagtttagctccttcttcccttacagggattttccttccgattttgataatctgatgtaatgcctgataatctcgcgactatcaatttcaacctgatgcatcatgacccagtaattgatgttcggatctttttccagatgctttttgatactgtcaacattggcattcatgaaatcacagccgacattgattttgttaataccgtattttacacaattttctatgtttttatccccggagccggaacctccatgcagaaccagcggcattttggtaagctccttgatttcctttagacgttcaaagtcaaattctggaacatagccttccggatagttgccatgagaggagccaaaggagattgccagcgcatcaatgccggtttccttcgcaaagcgcaatgcctgctgcgggtctgtcttcatggcatcatttgtataattgccgccttcactaccacccatgcatccgatttccccttcaacagatgcatcaaactgtctggcaaattctacaatttcctttgtcattttgatattgccttccagatcatagcgggaggcgtccaccatgacactggaatatccgtcatgaagtgcttttttcaaatatccgatttcttccccatggtcgaaatttaatgcaacttcaacactggcccgctgtgccagcagctttacgatcggtgcaatcagctcgctgtcacagtgattcaccatatgctcctgaacgatattcacaatgatgggagctcttaaatcctgcgctgcacttatgacagctcttgctgtttctatattaaagcagttgattgccatgactgcataatttccttcgttggctctttgcagcatgcctttcattgatacatacattgcgatccctctttctttttatgagaatgtgatgccggaaagatccatttcctcttcgacctcttccacctgaacttcatcagcgtctgttctcttctttttgataagtaccagcagaacagctgtcacacacgtaccggccagcagtgcgagcagggctgcgaatggattggtcatggccgggataacgaagacaccgccggatggcacggcacttcccacacccagagtaaagctgatagcgcctgtaacaccacagccgatggaggtacagataaccgtacgaatcaggtcattcatagcaatcgggataacaccctcggaaatcatgcacagtcccatcgggaaggcaaccttgatgttttcaacctcagtcgatgtatagatgcgttttttgatgaatttagagataacaagggataaggtgattccaagtggcggaaccatggctgcaagcaccttgattgcttccggctccagaattccttccagcagtaacccgtcgcaaataagattcggaaccttgctgatcggaccgccgaagtccagacatccaagggcaccgatgataaagccgtacagaaccttggagctctgatccaaacctgtgatgaagtttgtcagaccttctgttaaccatacgattggtgtaccgattacaaagtacatcagtaatcctgcaatgatggaagataatgttggaatgatcatcatcggcatcagtgcctctgcccagtgtggaaccttcagatgctttctgatgaacaatgcgatataaccgacaatgtagcctccgaccataccgcccaggaagccggcacccaggaaggaagcaatctgccccatcaggaaacctggagcaatacccggacgatctgcgattgaataagaaatataacctgcgataaatgatggaagaagacccattcccaatacaccgagtgatgtcaatgcactaggaatcgtcatcttgcttaaatctgtaactacctctccacccatcagatttccgatagcgatcagcagaccggaagcaactaccagcggcagcatataggagatggcggtgagggcatggcgtttcagctcagcaccaaattttttcataatcctttttcctctctttctttatttgtttaattctgcttcaattttttgaatcagctgcttcggtgccttcacacacacattggtaggaacctttactgtctttttcccctcaaagcgctccgtacctgtaatggcgatgtcaatggcaagaatgacaacatctgcggctttgatctgttccgctgttaattcatcctcagtaccgatcgttccctgtgtttccacatggattgtgtgtcccataccttccgcagctcgaatgagcttttcttttgcgatatacgtatgagcgattccggatgtacaagctgcaactgcaacgatattcatttgtacgtcctcctttctttaactgtctatattataaaatgtttccgacattccttccgattcattgtggtatttttaatactgccctttttttctttcctttgaaacagatgggaagataaatgtggtactttttattttcctgcaaatatctcctttaattcttctacattctctacctgcagcagacgttcgactgcctcatcattccccagctttctggcaatatccgccagcagcagcatgtggttgcgtgcatactcatgatcattgcttaccgcaaacaggaaaaccagacggacgcccttatcatccagtgtctcccattcaatttcatgcttcagctttgcaattgcgataccgacctgtgtcacagaatcactttttccgtgcggaatagcgatataattgccgattcctgttgttccttcactctcgcgcagatagatatccttcttgaaggcctccacatctgcgatatagcctgcatccttcagctttcctgcgagtaatgttaatacctcttccttatttgccgcctctgcgtttaagtcgatgattctctcatccaatacatctattagttgcatatcatgttcctcctcgtatttttttatgatataacattgcaaatcttcatgtttatcgcgtatacttctgtcgactactgtatcagatagcgatacagctccagattcgattttttactgcgtatgattttcaccttttcatctgtctctatcagcgatatatactgcttatagaatgactgtattcttcggatttcctcatgtgtggacattttaaagcccagcaggaagatcacatccacccggtcatcatcccagacaatcggttccggtaatactgcaatcgcgacatgggattcattcacttcactcatggctccatggggaagtgccacacggtttccgatactcgtcgttgtcgctttttcccgctccatgacggaatcatagaattttcctgtcacatagcccttcagctccatgcgctcacacatgtacttcaacagctcttccttcgtatcaaatgacgtattgatgaacatcagctcaggagagaacagctgaaagcagatcggctcaaatggattgatttcctccgatacccgaagattcagattatccatgaagctgcgaagcatcccgatccccgtatcacttaacaggttcggtatgacgataatgcgtctgtctgtttcctttaacagcttggagcttatgatgatatcctcatccggatgctcatacagcttgaaatcatgatgactgataaccttcagactgctgatttccggtacggttttgcgaatccgctcgcttagcagctgtgcgtgtcccagattgctttccgcaagcagaatggcactgtagcgctgatttcgtctttccagtgctgattgtatatacagcacgatatagccgagctcatcctctgtaatctgcagaccgaaggtgttctcaaacatcatggatatcgaccaggccgcacggaagaccgtcttgtattcggttttgatgaaattcacaagcgaattgctttgtggagagccgtaacgcagacggaatatggttggtcgcatatggaagatgagactttcccgcagcttgctgtcatttgtcagatccacttccagaatatttccgatcgtaaccagcatctcatcaataaaattcagtattttctgatcatattttgagatattggaaatcatatccacagcattgttgatgccgatgaatttcgagcataaaatctgcgttgccagaaacatgacatcctcgttggagaagatcacatgcatcttctcatgcagctttttgaagatagcgatggtaaacggatattcgttgtagcgttccaggatttcctgatcctcctgtgcgatgcgaagcggtgtactgaaatccttacgctgatatgccagacagcagtaaatgagtatttcgtaaaaggatgtatctgtgaaacgataattccattcattctccgtttcaataatcgctttctttattaaatcgatatcgatattggagaaaaagtcctgtgtctgtctgcgtgtttcatccagatcatgatccagcatgatatagtccttcaaggcgattcgatagcttgtttcatcatatttcagtgaacagccgcggcttcgctcgttgctgatttcaatgccatacggagcaagccatttttcacagtccttcatcacctttagaacggttggcggactgagatacagctcctctgccagcttctgtgttgtgatggtttctctgggcatcatacgaaagaatatctgcagagtttctcttacccgctgtgtcgcatcatagcctacactgaagtgctcggcaccatccagcagccgcagcattttttccttctgctgctcgtccatactcagccagattccgacacgcggcttcttttcaatggagccgagctgattctcctgtaaatagttttgcaggtgctccagcttatttctggttgccttttccgaaagagcaatcatggaagctattttacctgttgcgacgatatcgccctgtaccagtatcttcagtatttccttaatatagtaattttctttttcagacttcatagacacctcctgtatctgcagtttctacacttgaagaaacgcaagacaggctgctccgagcaatccgctgtcttcactcaggtttgtttttacaaccttcaccaacggctgaatattcggatacacctttgttttcactctctgttccacatcctcaacaaaccccggtatcttgattgcgacactgccgccaagaatgacgatttccggatcgacaaacgcatagattatggcaatcgtatttgcaaggtattccttggcatcctccataatgtcaatcgctgtctgattttgcgaacaggcaagtgcatatacatcgccggcatgctcaacatccaaaccggctttttttgcgcgtgttgtaatcgctgtaccgctgcagatagcttccaccccgccgggataaatggaaccatggctgggaccgtttctccataacggaatattcgcgatttcatgcgcaaagccatgtgctccctgatagatctttttatctatgacaagtcctgagccaagtcctgtggaaatggtcagaaactgcacataggagtagtctttcccctgacccagaacagcttccgcaagacatgcgagattcgcatcattttccagaaaaaccggtacctttaaacgtgcactcagctctttgcttaccgcaagaccatgccagcctccttttaaattgggagtgtccagaataattccctgcttcaaatccaatggacccggacaggataaaccgactcctgcgatagccacggaaaagctctgcaccgtctcctgaattttttgaagtgttgcctgtggattatttacatctgtaggaaactgtatcctttgaataatctcatatgcttcatcaatcagtgcgattcttgtattcgttcctccgatatcaattcctgctgtatacaatcgtatccctccttatttacaagttaagaataccatgaaccctttattccctcaaaaaaatatggggaatataaatgaggtagtttttcctttttgtcgattttgcaggaatacatatgaaaaagacctgtttatagtaaacgcatatcgttctttataaacaggtcttttaatcctacttcaagctgaaagattcgttgctattccaaatcctcaccgttggatgctatcacttttttgtaccagtagaaggaatcctttttgtatcgattcttagtaccatttccttcgttatccagatctacatagataaacccatagcgtttcttcatttcacctgtggaagcactaatcaaatcaatacacccccatggagtatagcctctcaaatccacgccatccttcagtgctgcatgcatagctctgatatgctcgcgcaaatagtctatgcgatacggatcatggatacttccatcctcctccagcgtgtcaattgcccctaagccattttctacaaccataacaggaatttcataacggtcataaatatcattgaggaaatactgtaagccgtccggatccattccccaaccccagtcagtatattgaatatacttattttttacaccgaggctgagattgcctgccccatccttttctacgccctcatgcgtcgttacgcagcttgttccataataggaaaaggtaaagaaatcaacggttcccttttccagctgctgcatatccttcaatgtacaatcaagttcgacatagtcttctttccagattcgttttgcataggccggatatttcccccgtaccataacatcaccgcaataataaaacgcatcctgcatctttttttgtgttttcaggatatccttcggatcgcaggtcaacggataattacacatccctgccagcatacatcccacctgataatccgggtcagtctcgtgcgctctttgcacagctcttgcacttgcgacgaactgatagtgcagctgctgataataagaggataccatttctctggttgcattcggcatccagtctttcatcataatcaggcaattgatttcattaaatgtaagccagtatttaaccaaccccttatattccttaaaaatgacttctgtatagcgatcaaaataagcaatcattttgcgttcattccagccgccttcctcctcttccaaataaagcggtgtatcataatgtgaaatcgttactaagggttcaatatgatatttcttcaattccatgaacacgtttctgtagaaatccaagccatcctgatttggttcatgttcaattccctgcggaaagatccttgaccaggaaattgacatccgaaacattttaaagcccatttcagcaaacaatgcaatatcctctttgtagcgatggtagaaatctatcccctcctgattgggataataatagccatccagaactgcaccttttcctccctcaggaataccttcaaactgagaaacagcacccgtcgttccatccggcatgcgataggtcagcattctcgccgtatcagccgtacctgctgtcgtgatatcggttcttgcaggtccacgtcctcccgcattccatcccccctcgcattgattggcagcagttgcaccgccccataaaaaattctttggaaagttattcataacgttttatcatcctttcattcctctagctttgcgccattggacgctatcacctgttgataccagtagaagctgtcctttcgataacgtttcatctctgctgtttttgcggcattatcatcctcattacgatctacataaacgaagccatagccttttgaaattccttctcttgttgaaaccagatcaatcgcagaccatggacaatagcccatgatatctgcaccttcctcgataccgatacgcatttgacgaattgtttcccgtaaatgctcaatgcgataggaatcgtgaattgatccgtccgcttccagtatatcttctcttccatagccgttttccgttatcaacacaggaaggtgataacgctgcgtcagtcttctagcggttatgcggatacaatagggatcaaagctgtgtccgtcagcttccgacctcataaaatattcattttgcacagcacgcccgatacccggcttatccatcagcttcatcaaatagcttacttctctgttatccgcatgcagcatagcttcatagtcaatttcaaagtacggcagatattccgttgtatcattaccatagcaattgaagccgataaaatccggatggcaggttctcatgcattcaaaatcgccttcctctgtacgtatctgaatgtcatttaattcaaagtagtgattgacactttccggatatttcccgaataccagcgcatccaggtaaaaattatttctcagatcatccatattcattgcggcgatataatcgattggattgcacgatttcggataggatgttgtaatattcggtgccggtccgattttcgcatccggacacagctcatgacaaagatgaattgcctttgcctgtgcgaccagctgcacatgagcctgattatataatgcatctaaattctgcaccctgccgctgccgccagtcatatccacggccccaaagaaaatcagcatattctgttcattgtacgtcagccaatatgtaacatcctctttgaattccgaaaacagcactctgcagtaggcgacataggcatccatcatcctgcggttattccaattcccgtatttcttttccaaagcaagcggtaaatcaaaatgaaagatggtaacaatgggttctatgtcgtatttacgacattcagcaaataccgctttataaaaatctattcctttttgatttatctcattttcaccatcaggcaggatacggctccaggaaatggacatcctgtatgctttgaatcccatttccgccataagtgcaatatcctctttccaatgatgatagaaatcggaagcgtaatgaaaggaacaggttccttcattcagttgcttgacatcccagatagaaagtccgcgtccatcacaatcataaccgccctctacctgcgcgctggaagagctgccaccccataaaaatccttccggaaacgccatagctaaacctcctgtgcttccagagcttctgcttgttccttttcaatacactgcttttcataaattttgaagaacggataccagatgattgtcagtaaagggaaacagagaatcgcaaacacgacatttttccaatcaagagtacccataaagtttgacattaagacaggcagtgtggtcataatcaataccgaaggaagggcaacgatttccaatttccataggattaaattcaatccggctataataagcggattcaataagaatggtataaacagaatgggattgtacataattgggaaaccgaaaattacaggctcattgatattgaaacagccaggaataaaggaagcctttgatattgctctaatctgttcggatttcgattttagtcccaacaggcataatggaagtgtattccctgtaccacccataattgataccgcaccgaacaggaatacaggatggaaaacaagcggctgtcctgctgccatcagatccgcattggacatatacgctgtcatcatgggaaccattagcgctgtaaagataacagaggttccgtgaataccaaagaaccagaagaactgcatcagtgccagaataacaaacatgcccggtgtggaaatcatgaaggaaacagggatagacaatgcataggtaatggctccggaaagcgtcaaagccccctgtgtcaccgtatccagaatcactgcaagaccataccagataataacattcactgcagtcggtataatgctgttaaagctgttcaggataccttccggtaccacatccggcattctgatgatccagtgatgatctgtcacaaacttcgtaacacgtactgtagtcatggcaatgatgattgctgtaaacagtccggttgcgccaaaattatcaaagttaacgacggtcattgcagtttccccaacctgcacactcatgagtggacagcttaccagaaaataacaaatcagggaagtaaatccgctttgtactccattcagcttaagattcttcgcatatgtgtaagccatattgaacgccatatacaatgccattgctcccatggtccactgataggggcggtacaacgtctgatacaattttcccgttgcgtccagccccagaaaggttgttccaacgacacagataatctgaacaatcgctccaatcataaccagacccatggttcctcccataccattactgatggcactgaacgcaggagatccggataacttcatgcttatactttctaaatatttcatgaatctcgattccgcaaatctttcaagcacattcatgtcattactcctttcctgcactgattttttttgccaatgccacaatattctttgcatttccaatcgcataatcctgtggtgccatcgcttcaatcggaatggaaaccatcttctgtaattctttaaatcgatttctaacctgcggtgcagttaatacacagtcatatcccttttgtgcttcctcttcacaatctgcgacaccgacagcttcaatcacgatatcctcaccgatttcttccccatattttctaacctttttcataacgatgcttgatgaaagtccgcccgcacataccagtaatattttcattttctttctcctatcataattttcaaatcatagatctgttcatacattgtaatcatctcgcgaatcaattcaaaggctataataccggtcatgagatgatcctgagaatggatgagcagcacatcaatgtctgctttttttccgtttgcttcctgtaccagcagacctgtctgcgccttgtgtgcccccagagaagcctgctcactttccttcaaaagtgttcttgctttctcaaaatttcctgccttcgcttcttccaaagcctcgaacgccaatgctttcccatcaccggcactcgcaatgatctgcattgctattgtttccatatccattaacacgttcttcctttccttgttcgtatacaattgagctcgttttgtctacggcactactataccctgcgtataaacctgcgtcaatctgctgaaattatatgatttttaagaatttatacactattgaatcaaaatatacactacgctgattctttgctgaataaagctgcattccgtatggataaaaaagaagaaaatcatacaatctgtattttttcttctttgcgtgcaaaatcacaatgtataagcttatatacacaaataaatcttcatcttattttataatttcaataatcgtggcaagctcgtcatcattgaatgtaaagttcattgctgcctccagctctgccaaaatgtcttttaagctgtggtaaagcttcttattgtgaagcaaaataccttccttatgaatattttttaaaaacccctctccggattttattcgatttatcgagcatgccacatgcataaaaaggcctacctcttcattgatggtaaaatccggaacgattttcttgatattctttataatacccggtaccgtttttttcaatatcgtgatatcgatatgttccagctgctcctgtaaatactcatacattgcatcaaaatcaacactatctttttcttctaaatcttccaatgccaaaatcatcggcagcttatctacgggtgtatcaaaaagcttcgtgatggatatataaggtatatcaaataatcgtggatcgtatgtaccgactacacacagtatttcatgatcctccttgattttactgatctcatttatcagtaaattccggttgctggtagccaaagctaatataaagatatcactcgtatccagattcttttccaggtattgcttaatttgaacagctgaccccttccccgtcatacacaaggtaatgatagctttatgcttttccttcacattagtttctttctcccacatgccgatatcaaacccgtttgtcaaaatatcatcataagtgatatccaaattattcgatgtactcagcttcaatgcacagtttagtgtgatcagtgttatcggtatttctagcttcctgatacgtattccagtttcatgaataatagaatcaatcataaccttcacagactccatatcataaataatcataatacctgtaccgttatcaatcattttgcataggttcttcaattcctcatatgcctgcttcatttctttttccagtgataaatcataagaatagacaatttgttccttatatatttgattcaccgtatctgcaatcgcagaggcaatatttccatgcatgacaaccagcagggaaggcttatgcttctccttattttgtatctcgttctcgcagagaaagaaggtaataaaaataacctcatccatggtaatttgaataccatacgcttcttccaatctagacgcaaagctcatagagtatgcatattcatccttgtatttttccacaacctctataatcttgtcatttgataaatgctgggtatatccttttttcttaatacaggtggttaaatacagacacattgcatagaaggtggaaatggagtataccttgttaaagcaggtcgatgcccctttgaaaaaggtatccacaagatcgatgatacgattatccactagttttgttaatacatttcgatcaatttttgaggtctctatataatttttaattgttgatacatcattttcaatcccggaactgataatcgttataatgtcatcttcttttatattgcgttttctcaattcctcaacctttttttcaattgtatcatatatggaggtctgatcgaccttgagaatcgtctcttcatattttttgcttctgttcttcgtataggtatatctgtaattatccggtatcagcgcttctattttcttacgattctctttatagaatagaaagcctttccgtatgtaagaaggacagtcatgaatataaactcttaatacatccgcattttgattgatatcacggacataggcatttgcacacccgattttgatatcattttgcagctgtaatacatttctttgacaaaaataaagtaaaaagcaacgtaatagctctgagtcaatttgtatttcttttttcaccttctctgcttcatccatgaaaaatttttctacaaactccagacgctcagagagtggtctctgtcttaagtccggcagttctatacgtatgggaaacgtatttatgtaggtatcatttaaaacctcttttacactccttaccattgtgcaaatcaaaatgtagtctctgcacagcaacgtattcagctgttcaaagaacgcagtcaataccttggatgacatcagatcaattcgctcgattaacagaactcctccttttacctggtaaatatagccaccgctatctgaaaataaggaagagagaaaatcctcttcattatcaatgaactgattacaatttacagtgaccaggggagcctcctttcgtatgatattttttcttttgcaaattcatacatttgattagaaaagaatgttttgccagtgccctgttcgccgacgatcaatgtactcatagcgtcttccggataaagaatagctgcctttgctaattgaacagcattcttcaggctgccgttgacaccaatcagttttgagaagcaggataaatgcttttcttcctttttaccttcttttaatctatacagtacaggtctttgctttgatttttccagaataccctgcttaacacaatcatttaatatcgctgaaagattggttctctgtatatttaaatcagccgacagctcctgagtcgtaaagcctttgaaatcttcacccttttttatggtcatgtcctgcatatacattaaaaccatttctttatttgtcctcatctatgatcacctcggttatcagataacaccttcatttttatagtatcatatttatacttaccagtaccgctaaaagtataagaacatagtgtataacaggttatacagtatcacaagagctttgcatgaaactgcaccttgctgttcactcatatgtgcgagaacagcaaggtcagattgttatgtctgttatgtaaaaataaagagggttttcttccagcatccacagacagaacctcaggctgtcctcgcttgctatataaaaaaagccaatccgcttattaactaagggactggcttatatattatatatacctaggcagatgttatacaatacaattattttttgataatactttcattccagtgttcattcggtgctacttccagcaggtctgctacggtagctgccacattggataatccaagctgctcatcctgctttagctctacatcagcaccgtaaatgatgaacggaaccttgtttaatgtgtgagatgtctttgcctttacaggagcatcttcctttttcttcttttcatacatttcatcggcgtttccatgatcagcggttacgatcagaataccgttaactgcatccacagccttctttacacgggccagctgcaaatccactgactccacaccgattacggtagcttcaaagtttcctgtatgtccaaccatatcaccgtttggatagttcgtacgcaggaaatcatagtttccggattcgattgccgcacacagaacatctgtaatttctgcagatttcatccaaggacgctgttcaaacggaattacatcggatttgatttccacatagtcttccagcttttcatccagcttttcggaacggttaccattccagaaatacgtaacatgtccgaatttctgcgtttcactgattgcatattcacggataccatgcttgcacagctcttccgtcaatgtatatttaatttttggagggtatgtcaggaaattatgagggatgttcaggtcagcatcatactgcagcattccggcaaacatcaccttcggcattctgacacggtcaaacttgtcaaagctgtcatctccgtcaaacgccagagagatttcctgtgcacggtcaccacggaagttgaacagaatgacactgtctccatcctcgatcgtaccgaccggctttccatccttcgcaataacgaatccaggcagatcctggtcaactacaccggattctgcacgataggtttcgattgcttccttcgcagacgcaaattctctaccttcgccaagcacatgcacatgccatccctgctcaaccattgcccagtttgcttcgtaacggtccatggtaatggtcatacgtccgccaccgcttgcaatgcaggcatggaagctgtcatcgttcagctcagccatgtaagcttctatatcatctacataggttaatgcacttgtttccggaacatcacgtccatccagcaatgcatgaacacgcacttccttaacaccatcttccttagcctttttaatcaaagccttcagatggttgatgtgagagtgcacgtttccatcagaaagcaatccgaggaaatgcatctttccatccttacagttatttacaagtccgctccaggtttctgttttaaagatttcacctgtttcgatattttcatttaccagcttcgctccctgagaataaatctgtccgcagccaagtgcattgtgtcctacctcgctgttccccatatcatcatccgtaggaagtccaacagcaagaccatgtgccttgatttctgtatgcgggctgttttcccacaggttgtctaatgttggtttatacgctttttttacggcatttccaaattcggaatcactgattcccacaccgtccataaccactaatactactggtcttttactcattttcaatacctcctgtattccctaataatataacactttttgctggttttaggaatccttttatatcaatttcagccgtttgcatgaaataatcttatgcctctatatgtatttttcaaggaaggtatccaccttttcccaataggccagcggatcggcctctctactctttccatgtccggctcccttaacaatcataagctctttttcaccggcagctgccttatatagagggtacaccatatctgttggaacgaaatcgtccgcatctccatggatgaacagcatggggacctttttcctttttactgcggctagcgcatccgcatcctttaaatcatagcctgcacgaagctttgtcacaagatttgcggcatccagtgcgggaaaagacggcaatccaaacaaatcatccagctggaagctaaattcatcccaggcacttgtatagccgcagtcttccactgcgacttttacagcatccggaagctgttcgttaccacttgccatcataaccgtgctggctcccatggatactccatacagagcgatactggctgagctgtcctgcttcagaatatacttcgaccattcaacaatatcctcgctgtcccatgcacccattcctatggaatcgccttcactttgtccgtgtgagcgaagatcaggcaccagtacacgatatccctgttccgcaaaatggtttgcgacctctgccatgttttttgcttcgctgatgtagccgtgaacaacaatgacccatttatttccggtttgattgatttcataagcatgcagcctatagccgtctttatttttcatccagacatcctttgtatcacgcgccatcatttcattataggaatcctttgatgcctgtgctgctttgggatcctcctcttcatttccgaatacaacgcttttatcactatgtgcgtcaatcgccagtgtatagaaataattaccggcaaatccaagaccgcccaataccagaatcagcagactgataccaattccgattactacctttgttctctttttcatatcatcactccatttacttttataatcaaactttgttattatagcagacattatctgaaatgcaagcaaatgaagaatgaattgaatatgaatcgttatgaaacaccataaagctgaaaaaaactcatgatgtgatacagaatggagtgaacagcttttattgcatggctcgaatatatcatatagaagattctcatattgaatgaaaaagctctttgcgaatttattttttcttttgacacataaaaaatttcgataaatataaacaaatagtggattatttaggaattcagtatcttccatacgtatataggggtgtaaggaacccttacagaatggaggacataaaaatgtcaaacacaatgcatcaactcagctacagtaatgatctattttttaagtacaccctttcccgtgaggatgaaggctctgtgtacgcccgcaacaccatcattgaacgtgttaccggaattcgggtaaaggaaagcaccgtgctcaatcccaatctggatccgggcatcattctggatgttcatgtgaaggatgaacaaaaccgccatttcaatatcgagatgcagaccacctacaagggattagcggaaatgatgcgctttgaattttacggtgccagagcattgaacaatcagctcaacagcggtaagaagtacagggatttaaagccggtatatcagattattttcattgacgagtatgcatggaacaacagaaatctgatcaatcagtatcagatgcgcaatgagcagggagagaaggaaagctactatccgctcatccttcgcacctatattcatatgccggcaatcaatgacatcgtaagggagaaggaaatacagaggctgaatgactttgaacagctggtgtatctgtttgaaaacaatggaaaaaatgatatactgaagtcaaaggaaaggctggtgaaggtattcatggataagtacgaggaaatgcagaaggatgacgagctgtggtcaaccgcaatggcgattcagatgggagaggcacgttaccgctatggcttggaggacagctttgaagaaggaaaaattgaaggggagaagattggtatacagaaaggtaggatatcgctgttactcaagctgttaaaaagtaaatatcatgaggattgctcagcctggctgctctctttgaatgatgaacagatggaagccgtatccagcttgatactggtctgtaattcttttcaggagctgaagaatcaggttacgataatgaagtaatacatacaatcccaactaagaaaactgttttatgagcgcttctgataaaacagttttttgttctttttcactctcaaacatataaagccctgttcatacagttgagccagtccgcttcacctcaatctgctcattatcctgagctatacacgtatatcgcgtatgaagaaaacagcagcgccattcggcatcccaatccctgaagcagcacaggtcttttacaggactgcagggaggacagcctatttcttaattcatcagcctatattggtatacaggagttcataatcaacaattccattgcttaaaagctggctttccagtaggtgcccgacacgaaaacctatcgtacatgcaatagaaatggaagctggtgtaagccagatacagaagtaatccttataaaacagtatgaaccaaaaaatacatatccaaagcagatatgtattcagagtattcttgaaaatgccaggatcagaaacagaactccactgacccaggacagcctgcattctttcagcgatagcactctgctgcccagaaaggatccccccagaattgccagtataccgacgcagaaactgatgaccagcaccggcagaggctgcacaatgctgatacccagcgcaaagccgctcgccagtgaatcaatcgacagagccacagccagatacagtgcctccttcagggaaagcagcttgctgttatccgcatccgccttggtttcatccagatagatgtccagaacaaacgatattccactgtattcaaagctcagctttttccgtttataggtgccaagaaacgacttgatggttccctgaaacagggagctaagaccaatcataaagaaaatcgtgaaggatatcatgcggcagatatacggcggtatgaactgctgtataaatgctgctgtatacagggaaaatgacagaaacagcacaccgatcaaggaaatcagaaccgctgatttccagggtatgcgtatatgctcgccaccataggcaagagaggccagaaagctgtccagactcagggcaatgacaagtaaaaaggcattccacatgcttatcagactcctctttactatcatattgaatctgaaaatttatgtgacgaacgttttacggagccttatccgacggatttctgtttcggtttctttctaagctttaattcagcaggtattttagcagcggcctcctgcagcagggacgcagcaagctccgctttttcctttcttgtgtacgtatccgtttttacttctgataaacgttgcatgacacctctcagctccttcagctccagcagatttacagcaagtgtaaacagcgttttccttctgccatcattataatctgataaaagctcctttagaatctcaattttttccagctgttccttgtgatatgcagcggcacctatcgtatgcatgcgcatgaaatcctgcatgcggttgcggtgcgtgataaaggaatcatacgcatccggttctgcataccgctcacaaggaaattcagagcatgcagagcaatacatcggtgtatcctccttctgcatagcacaccgtgcaatcgcacacgcctgatttccggcacctcccccgcaccctggacaatacccgcccagatgcatactgcaaagtccgcagttcaacccgcatagtgaaaacagctgatcctctctttcaaaccccttcatgcacacacctccgttttgatacaaatctgcttctctgtcttcattctaccatctctatttcagaaagtcatgacttttatcggcatgtgtatatcagagcttggcttgcaggcaggagacggttagaatatacagctggcaattacgaaaaaaaacaggaagcgagccatgtcgaaattgctcaatcctcctgttctatatatcaggtgctgtgtcgaagcatgtatgccggatagcgtatgcatgccggcagaagattacagctctgtaatattacctttcttatcagccagaatcacactcatattcagactgttttttactgccttcggaatttcattccactgtctgcgataggaaacagagtcgttaaatgcaatactgtaatgtgtatttgtatcctcaatatgctttaaaacctcgctcagcttcaccggcagtgtctgttttcttccccgtttgatcccctgtacattgatcacccagcgctggctctcgttgtgtgcttcaatgaaatccttattttcgatgtattcccagccatgctcacccagccaggatttgataagattgcataaatcctctgtatttctcttcatttttgcttttcttgcggccagcttttcttcttcactctttgccggtcttccgcgtttcttattcgggaacatacgctctctttcctccagctgctctacataaaagcgtaccgtcagatgagaaccaaagccggtatttccctttggtcttctgagaatctcatcgccttccagcatcagcttgtagattgcctggcagcaggttggcatcgttgcatggtttgggctcacgttcgcatgcagctccttggagtttacttctataaatgccttgccttctttttgtgcagtcaccttcatgttttcaataacttccaagtaatctttaattcctggacctttcattctttaacactctccttttattgcttacattgtaaatgttttgatttgtcgaatactatcacaatttgaccagttaaaaaatttttttaaaaaatatgtgtataatagagttaggaagtggtgaagacatgagaaaaatgctatttaagaaaattttgagcatcctggatgccatcgagctgcagggtgttagcttacatgatgccccgttgcgtgtatatgaggagattgcaggcgagtattatgccatgaagctcagtgaaattcgggatttgatcggctttctgaatgaaaagaaaatgctgaagacaacgccgcgtggaattgatttaacgcctgcggcaacaatctatgccaaaagcaatcagaattccggtgtggaggctctgtctatatttgaaagctttatcaaggatcctttaattttcagatactatcatgaacagatgcggacaaatccgtttcgtgataaacagcttgtcctggaatatgtcgacagagaaagccttcagctcatgctgcagacaactctgtttgaggtcgtggaggagaagctgcgcttccatccgcggctgctgaagggaatatcggatatcctgcaggaatacagtgatgaaaaagtaccgctggtatccatcacactgactgcgctgtacacctccattatcgttgctcacgaggatatgcgtattgactataagaataccagctacagtatgatcgattataaatataagaatatcatacatggcatcattccaagaaaagggatcccccatgaccgggatgaaaccaaggcgctgcaggtattttataaggatacgctgtttcatgagtttgaccatagctgtccaatctgcggtatcaatataccacatatgctgattgcatcacacatcaagccgtttcgtgactgtgcgcatatttatgaggcaatcgaccacgacaatggtttgctcttatgccgcaatcatgattatctctttgatcagggctattttacatttgatgaaaatagctatatcatcttcagtgaagagctgctggaaaaagataatctggacagtgcctacagtcttcgtaagaactacaggcttgcagaatgctatctgagcgaaaaccggatgaagtttatggcatatcatcgggaatttatttttcacaggaacaggtaagatatccattccttattatagagataaaatataaagtaaatattaacagaacataaaatagtatgtgaaattgtcgaagaaatgatacctgcagatcctaagaaatataccatgaaggaagctcactgcttcctttttatatggcaggttacaatacgtggcagcttaggataaaaaagatgttcaaaaatctagggcaggatgatcgactattctaactgtaacttttacacttacagtaaaaggaggtattgtatgaaaaaaatagctttgtttaccgtatttgcctgtatcatggtcatactgcagggctgcgcaaaggatatgccgacggaggagaataaggaagctgtacaggaaaacagcaatgcctatcacaaaattgacgcgaagaaagcaaaagaaatgatggatgccggaaaggtcacgatcgttgatgtaagaacacagcaggagtatagggaaaaacttataccggatgccgtccttgtaccgaatgaaacgattgaggacgaagcgaaggacaagcttccggatacggatgctgttttgattgtacattgccgaacgggagtccgcagtaaacaggcaagcgacaagctggtacagatgggatataggaatgtgtatgattttggtggtatcaatgactggccgtatgataccgtaagcgaataagcttatgaatagcgaatttattattgctctgcatgcacttgcctatctaaggcatcgcaatacaaaggtttccagcgaggagctggcgaaaagtatatgtacaaatccggcacgcatccgcaaggtgatggccaagctgaagaaagcaggactgctggaaacaagagagggtaacagtggcggctatgagctgcatggcgatgctgccgcaatcaggctttccgatcttgcacaggcgttacagcagccgctaacgaaatccggctggagaagcggtacactgaatacctattgtatgatagctacgggtatgggtactgttgtggacacactggaagcttccctgaatgaggtgtgtatgcaatccctttctcaaatcacgattgaagatatcagccaacagctgattgctattgaaaaccataaaaataaggaggaatgaagtatggcactcgtaacagcaaacaatgagaatttttatgaactaattgaaaaagaaggaaccgttgtggaattctgggcaccgtggtgcggatactgtaggcgtctgtcaccggtattgaaacagattgcaggggagtatcctgatctgacactggtacaggtgaacattgatgattatgaagaactttctgatcgctatggtgtggaaacgatcccttgcatgatggtgttccatgatgaaaagccatccactcctttgattgcaccgcaggcaaaagcgcaggtaatcacttggatgaaggaacaaaaagctgcaggaatcgaatagaaggtgaggtattcacatgaacaagcagatatatgatgtggcgattatcggcggcggtccggctggctatagtgcagctttatactgtgcgaggagtgcattatcggttctcgtactggaaaagctatcagcgggaggccagatggcaaccactggaatcgtagagaattatccaggctttgaggaaggcatcgacggctttgaccttggagaaaagatgcagcagcaggcagaacgctttggcgcaaaaaccgtttatgccggtgttgaaggtgcggatttaacagcgcagccaaagcttttacatacggatgaaggcgatatggaagcgaagacggttatcattgccacaggagcctatccaagagagcttggtctgccaaatgaatccagtctgcgagggcgcggtgtcgcttattgtgcagcctgtgacggcatgatgtataaagggaaggatgtcattattgtcggtggcggaaacagcgccattgcggatgctctgtatctggaaaagatatgcaaaagtgttactctgattcatcgtcgcgaggagctcagagcaagtaaggtgtatgcgagatagctggaaaacagtaccatccggtttgtctggaacagccgtgtaaaagaaattctcgcagataaaagggtcagcggagccgttattgaaaacatgaaaacaaaggaaacacaggtcatagctgcacaggggctgtttgtcgctatcggtcgcattccggatacagcagtctttgagggacagctggaagtaaacaaggcaggctatatcgttgcggatgaaacaacacgcaccagtattcccggtgtattcgccattggagatgttcgtgataagcctctgcgtcagatcgttactgcggtaagtgatggagctgtcgcttctaagtttgtagacgaattccttgcaggattgccgcaataaagttacaatgaaacaaacatagcaggatgtgacggcattcggggaggaaagcgtatgatacaggaattgtttgattttataacacagcgttgggattttctattgccgcttatttatgagcatttgcagatatccgcaatcgctattgtctttgctaccatagtaggtgtcagtatcggtattctcattgcagagaaacgaaaggcttcttctctgacacttggaatcatcagcttcctgtatacgattccttccatttccatgctgggctttctgattccggtaacaggaatcggtaatacgagcgccatcatcgcattgagcatttatgcactgcttcctatcatacgtagcacctatactggtatcaccggtgtggaagaggatattctggaggctgcccgcggtatgggaagtaccgctgcacagattctctggcgcattaagcttccgcttgccatgccggttatattatccggctttaaaaatatggtggtgatgacgattgccctggcgggtattgcttcctttatcggtgctggcggtctgggtgtcgccatttaccgcggtatcacaaccaataatttaacgatgacgctggcaggaagtctggcagttgccgtacttgcctttgtctttgatattctgatgaatattctggaatcctttttcacaaaacggaagcattccagaaaacagaagcgcgccgtggctgttgtgcttctctgcattctgcttgcgggatgcacgaccatgcttacgattccttcaaaaaaggataccattcatatcgccacaaaaccaatgacagaggaatttatcatcggagaaatgttgaagcagctgattgaagatcgaacagacctttccgttgaaataaccaaaggagtcggcggaggtacaagcaatattcatccggcaatggttaagggtgattttgacatgtatccggaatataccggaacctcttggagctttgtattaaagaaaaaagaaatacctgaacacgatatcctgtacaaggagcttgtcagagaatataagcagcagtatcatctggaatggacaggcttatacggcttcaataacacctatggtatcgcggtcacaaaagaaacagcacagcgctatcacttaaagacctatgctgatttggccagcgtatccagtcgaatgtcctttggtgcagaatatgactattatgaacgtgatgacggatatgatgctatggtcaaagcaaatgattttcatttcaagaaaagcattgatctggatatcggtctgaaatatgatgccctgttgaagaaagaggtggatgccattctggttttcacaaccgatggaagaatcagtgatcccgatatcgttgtgctgcaggatgaaaacaattattttgagaaatattatgcaggaactgttgttcgtgaggagacacttgccacatatccccagctacgcagtgttctggagctgttaaatggacagatcactgaaaaggaaatggcggagatgaacaatgatgttgaaaccaaaggcagaaatgaggcagatgtcgcaagagatttccttgtgaagaagcagcttctggaggtgacaaaatgagcagcataagaatggagcatatcgtccactcctatggagagcatactgtcctgaaggatttcagtatggatattcaggacggggagtttatcagtgtaatcggtggaagcggaagcgggaagacaaccgttctgaagctgatcaatggtcttctgattccggatcaaggcgaaatctatgtgcaggataaggctattcgcaaggtggatcagaatgagctgcgccgcaatatcggctatgtcattcaaagtatcggtctgtttccgcatatgacgattgaagaaaacatcggttatgtactatctctgacgaaacaggattccgctttgattcaggagcgtgtcaaggaaatgatggatatcatgaagctggagaagcagttgctgacccgctatcccgacgagctgagcggcggtcagaagcagcgtgtcggcattgcccgtgcacttgcttcccatccgaaaattttgttaatggatgagccgtttggtgccgtggatgaaattacccgccactctcttcaggatgaaattctcaggatttatcatgaattgcacatcacaattttcttcatcacgcatgatatccgtgaggcactgcgtcttggaacacgcgtcatgattatgaaggatggcaacatcgaacagtttgatacaccggatattgtgaaaaaacagccgcagacagaatttgtccgacagctgttatcttacctgaatgagtaaacctaggtatatggaactgtatcaaataccttatacatatcataatgaaaacggagagatgatgcctgaatcaaaacagcatacatactctccattttctatctgaaaagcaggcagaataccccacctcagtggtatacaaaggagaagcggcagggatcagagtcgtggtctgtgaagaagcaatacaatcgaaggctagttccattgacgaggatcaaataccagtctatggaaacgatgtagcgcataccttcacagggaaaagaatcaagcgaggattgtatagaagcaaaaacggcattctaatgaatgccgatatcaatggagcaagcaatatcatacgaaaagtatatccatgtatgccaaagcgagagcgatggagtagaggtacggtgaacgtaccagttacgtgtatctgaacacgaacaaaacgttttgatgaatgtgcaggcattcattagaagccgcctgctctatagctggcggtagttcacagcaatcttggtacaagcgctcatgtgatggcagctagtgttgagggctttgctaaggaagatattctagtacaaagaaatatatcctgagatcattgcaggtactgtaattgcatggagatgaaatatctcctactcacagcctgaacataaggtgataaaggaaatgaatgccttttaggcatgcatatatatgcagtataggtattggacatgatatagtaataaattatagaataaatgtgtaagttaagcttatgcatttatttttttacgctgaggaggatgatagtatgaaaaaaagactagtggcatatttcagtgcaggcggaacaacaaaaaaagtcgcagaaatgattgccaattgtgcaaacgcagacttaattgagattactccaaagacaccatacacagaacgtgaccttaactggatggataaaaaatccagaagcagtatagaaatgagtgataagacatacagacctgaattacttgatatagatatagacatgaatacctatcatgagataatattaggatttcccatctggtggtatgttgcaccgacaatcgtacatacattcttggaaaaatataatttctcagataaaaaaataattttatttgctacctccggtggaagtggatttggaaatacgatgagagaattgcagccttctgtaccaaacagtgttatagaagaaggaaggatatttaacaacacaaccagacagcaaataatgaaatgggtagaaacattataaaaaatggagagatgtaacatgaagaagataatacaaacagcaggaagaaacgcattagaagaatttgcaccacaatttgcccattttaatgacgatgtgctttttggagaaaactggaacaatcatgatatcgatgtgaaaaccagaagtattataaccgttgtcgctcttatggcatctggtattacagatacatcattaaaatttcatttacaaaatgcaaaaaggcatggtgttacgcagaaggaaattgctgccattatcacacatgttgcattttatgcaggatggccgaagggatgggctgtatttactttggcaaaagaagtatggaatgtgaacgaaggtgatttaccttatgaagatgcagcaatgcgggcacatgcaaaagacatgatatttccaatcggagatccaaacgatgattttgcaaagtatttttcaggaagaagctttcttgcacctgtttcaacttcccaagtggcaatttacaatgtgacatttgaaccgggttgtcgcaacaactggcacatccatcatgcgaagagcggtggtggacagattttaatctgtgttgcaggacgcgggttttatcaggaagaaggaaaaagtgtaatagaaatgaaagcaggagattgcatcagtattctggaaggagttaaacattggcatggagcagcatcaaatgaatggttctctcatctggcgatagaagtaccgggaattgaagtatcaaatgaatggtgtgaacctgttacggatgagcaatatttgcaattggaatacgaaaagaaaagctatgaactctgacacaaagtatcactaacaacaaatactgcggctcggacttggaacagctattatttgcagctgtaagagcttttattatgtttgcacttgaaaagacagcactttaaatatgtttccatgaggattgcatatcaaagccttgtgtttgattgtctcctatctgtacttcaaatctgtaccttgtaaagtattatcagaagcatatgctttcatcacttgtatttaagcagcttagcatttcagctatcgctggtatgtatgaaacacaagtatcaaattcggtcacaacccggaacagggggtattgttcaatgagaaaaggaaggtgtcaaatatgaaaagaattttgactacaattatatacattatatgtttaacagtacttgttgcatgtagtcataatacaacaggtataccagcatctgagaaaaacacagcgcaggagaatgatctcaaaatagcggttgtatatttttcagcaacaggtaatacgaaagctgtagcagaattgattgctgatgaagctaaagcggatatctatgaaattatcccagataaaaagtatactgaagatgaccttaattataataacgataattgtagagctaatcttgaaatgaaggatgatgcttcaaggccttccattaagaatgatttgagtgctataacagagtatgatgtgatttatcttggatatcctgtatggtggggaacaaatccgagaattattcaaacagttttagataaatacgatattagtaactcaaaaatatataccttctgtacatccggaggcagtggtatagaaagcagtatttcagatttgcaaactatgtattcaaacttgaatattgttgcaggcaaaagattcgataatcctacagaagaagatgttaaagcctggctggaaagtataggataaaaatcttatattcaggttcagtttaaaaagtgggaaattatatatatgcagtttgagttatagtatatttcatatccgctttatatagaagaattaaataatatgcttaattataagggctgagccttatatcaaggagatactacattaacataaaagaatacttatctgacaggcacagatgtggtgatagaaggtcttacatcattcttgtatcatgcagtcatgcagacataaggacaaagataatattataggataagtaatagaaaatcgcgttaatgccgccattccatatgggaatgacggcatttttgtctgtttaaaaagtccaattaaatcaggtgcttctttaaaatacaagcagcgcttatttgataagaatctaatgatctgagccctttgtatgcttgaaggcgcatcgaggtacgcatgaaatagcccgcttcataagagtttgagcatttctgcgaagtagtctccgccttactttagaccaatgtttttttattttggcgatgaaattgttattgaaattccaatagctcgtttattctaatcatcagctcaccatatggagctgtcgcaaaatctgtcacatccaactgcagggtcgtacccagtgcaaaggttccatatccccggcaggtacagcgctgtatgaattcatcataatccagcagattgtccgcttcctcatgacatttcagacagatacccttatgatatttctttacgatatgcccgaggtgacgggaagcgtccaaatcccgttttttctgcctttcaaatagaacatccagatcggcaatcatgcgaatcgtaataatctgtacatgatgcttatcacagacctcctgcagctgatcatgctgcttatggctgaacggataatcgctgagaagactgattccccgtgtgaatttccactccattctatgatagtattccacccagcttttctgaatcagttcttccttttcctgttcattgcggaaaccgtaggcatcccagaattcttccttgatctcatccggtgataaaatttcaaagccggtaaactgcttcattaacagctctgccagatagcttttacccgtaccgggatagccggcaagcaaaatcagtgtctgcttcatgaacgaacctcctgttatatggcaagctcaatctccagatggtaggtatctgcacgataataggtacagacacattcccttggatgattatccttatcaaaggatatgcggcgtatataaagcagcggactgccgacagcaatgtgcagcagctctgccatttctttgtctgccagaatggaatagattttctgcttggcaaaggaccattgaatctgataggcattggaaagaaagacacgcagagattctttcgaaaaatcatgctccatgacttccggtacaaaggactgctcgaaataattgatttccagatagaacggctcctcccccgcatagcgtacacgctttatgcgaatgatatcacaatcatcagatagctgaagacactccgcgatatccttgggcgctttcattactttttgattgatcattcgttttacggcgataacttgatccactctgtttttccttgtatagcggactacgcgctgtggtgatgtattgggctgtgccgatatgacaaaggttccgtacccgcgcttcttactgacaagcccgtcattggcaagcatctccatcgctttccgtgcggttgcccgagatacatgataggtattcatcagctcgctctccgccggtataatgcagcctacaggatatttaccgctgatgatgtcctgaaacagaagattatacagctgataatacagctgttgtcttccactgaaatccaatgcacccatgatgatccctcctcattctactgcctttttaatccatccattctccgcctgtcagattgatggactgccctgtcagataagcggaattatctgtcagcagaaatactgccgcattgataacgtcctgaagatcaaccagacgatgtatcgggatattctttttgaaatacggcatgacctcttccggatcaatgcctttcttctgtgcatattcatatttcagcttttcccacatttccgtgtatacaattcccggacatatggaatttacacgtatattgcgatccgcaaattcctttgcaatggactgtgtcagtccctgcacaccaaacttgcttgcacagtatacggtctgccatgcgcttgccttcttaccggacagggaggacatgttcaatatggttcccccaccatgcttcagcattttttcaatcgcaacctgacagcacaggaaggtagccttcaggttgacattgattgtcaaatcccacagctcctcactgcttttcagaaacggtaccattttacttacaccggcggaattgatccaggatgtgatagctcccagctcctgctccacttcatcggcagcagtcagaaccgcctgcttgtctgtaacatcaacttttttataaaccgcttttccatttgcgtccgtgatactgtccgcaacagccgatcctcttgcttcatccagatcaaggattgcgataccggcacctctttccgcaaaatccttcgccatggcagcgcccataccactgccgcctcccgtaattacgattacgcttccttccattccttcatgattcatatctatccaccatcactctctattttctacttcagatattccttaacacttaccggtttgtcctgcggcatcacctgtatgaagacatttacattcttctccaataattcagagaacgccttattttcctcaggacttgttgagatattcttatacagcacacttcgatcagctcgggcacccatgcctccgacatccacttcctcaatggcaatgccgtgatctaccagatagtttaatgcttccggccccttgaccagcagaatcgtcggtgcgtccagtccctgttcaaagaactgcacaccttcttccttggtgaagattcctattgcgatttcttccggtattgccatctccagcacctcgatcatatactcatcattcgctgttccgtcatccacgattaccacctgatccgcttttctgttcctgatccaggcagtcatcacctgtccgtgaatcagacggtcatcgattcttgttaatactaagttttgcacgttgttttttctctcctttcttgaataccgttgtctttacgccaactgtactcgatatgcctgctttatccgcaagctccttcagcgttgtttcttcgctgcgctccaatgcaagcgtcagcagcatcggcatattcataccggaaacaagcccgagtttgaaatcctttgaaagatatgcggcactctggaaaggtgtaccacctgcaatatcagacaaaacgatggttcctgaaccgctgccgtcatcggcttcccgcatgacagtttcaagcttttcacgataggcttccggagactcacccggaatgagaggcaccgccctcactccgtaatctccgcctgcaatcatctgcaggctggcaagcagaccttcacagaatgcgccgtgactgatcaaaatgatatttaccatagctgtcctctttcgccttctatcctacatagcccagaataccgctgtaatagcctgcgatacctaccaggaagattgcgataatgatccatacagtattgattttcttcttcagcatccaccatacaagcaatgtgattcccagcggaatcagacccggagcaagagaatccagtacactctgaattgtggttgttccttctcctaccttgattgcgagcggagtatttaccgtgactctggttgcggccatggatccgacaaccatcagacctacaatactgaaggagttgatgatacggtcaatcgtaccgtttttaagaattttcagcagtgatgtttttccctgcttatatccggtcataaacatgaagtatccgcagccgaagattaaaatttcaaagattgcaaaggacaggatcggtcctaaatagcttccatccagcgccatggagcatccgataccaaacagaatcgggaacaggattccctgcatgaccgtatcaccgataccggcaaccggccccatcagaccggtacgtacagcattgatatccttctctgtaacgttttcaccattcgcatgtgcctcctccatggaacaggcgataccgttgatgatcggtcctacggtgaatacttcagaattgtagaataccatatattttttcagttcttttacacgttcttcgttcgtgtcatacagctcacgaatcggtgtcagcatcaggttggcagcacccagagcctgtaaacgctcatagttgtagcaggcctcggtactcgttgtccataaccatgttttaacaagtgttttcttggaaagcttttttgtatactccggcagttcagctgctgcagcctgatcagccggctgtgaaacctcgatcgtttctgtttttttatttaatgagagacgttttaccttcttcgtttccgtctgcttctgtgcagtattgctgttcagatacataacaagtgcaatgattgcagagaagatggagattgcagtaagtcccagaccggaatatacggtcagaaagaagccgccgaagaaccacggaatcagctttttcttacccagatagttcaacagcattgcaatacccaaggccggcatgataccgccgacaacctgaagtgcactgatgacactttccggaacggcattgatcagatcgcttgcccagccgcttccggatacaaccagaaggaaggcaggaattccatacaggacaagtgccatacagaaggaaggcacgaagttcataaaacgcacaccgcgcagattgcccttttccagcagcttatccgcctgatgaatccatgcggcgttgactgtcatatatacctggttcagcaacagtccaaacatactgaacggaatcgcaaaggttacggccatcgtcggatcggcgccggataaaatcgtcatcgccgtaccgaagatacctgcgacgatggtattgctcggcatggttccacctgcggaaatccatcccagataaatcaactgaatgttggcccccgccagcataccggtcatcggatcccccatgaacagaccaaccagcgtacctgtggtcaatggataaacaagacatttcgtgacagggccgaagaaccaccactgccccattgtagctaataatgcaactaagattgctgataacaccataactatttcctcctgttagtgctcaccgcttacggaaaccaagaccttcccttttcttgcataacgcagggtctttagttcctctcccatttcctccaaggtaagctttgcacttattattttctttgtattgatctgtccgctttccagcaggtgcacggcacgctcgctgcatagcggattcagaaatgacgtataaatactgagttcttttgtataagcctcaaactgattgaagctgattggctgctctggatcccccaggccgaaaagcagtaccttcgcatatttccccgcaatgcgaattgcctgttccatggtggattttaagccgatgcattcaatgacataatcaatgttttcctgcttagcgacttcctcgatttcctgatcgctgatggccatggttgcgcccagctcgagagcaagtctgcgtttttccgcttcccgctcaatcacaatgattttggcagcacctgttaatcgaataagctgcagcatcaaggaaccgatggcccccataccatacatggcaaccgttttaccgctttgtatcccgatcagatccataccgtggaccgcacaggataacggctccgtaaaggccgcagcctccagatccagtgtatccgctatatgatatacattcttttccggcggataaacatattccgcaaagcccttggctacgccatgacgctccagacagaagtttggcagtccctgctggcaccagatacattttccgcatccccagctgggatcacaggcaacacgatccccaaccttaaagtatttgcactcaggccctacctctgtaacgataccggaacactcatgtcccagaataatgggtggtatgacaacacttgcgccgtttttcccctgaaacttatgaatatcggtaccacataatccgcaccaggcaacgcggatttttacttcatccgctatcggcctacgctctggtatatcacgcacctcatatccataatctccggtataatatccagctttcatatgttattcaccatccagattcttaaacagatgaatttttcgctccacgatttccgtgatggtatccaggcatggtacgacattatcgcgattggatatgttctcacgatgttcatcatagcactctctggatttacgattccagccgaccagcagctcggtaccgacattaaacttgcggatgcccagatcaataacacgttttacatcctcatccttaacaccggttcctccatgaatgacaagcggaatatcaactacctcctgcagttccttcagacgttcaaaactaatatttgtttttgatttatactgaccatggcttgtaccgattgccactgccagtgcatcgatacccgtctgcttcacaaactcaaccgcatcctcaggatccgtgtaacaggcatcgtcctggctcacggcgataccgtcctcagttccgccgacagttccaagctccgcctccacacttacattgcgagctctggcataatcgacaacctgtttcgtccccagaatgttttcctttaagggaagggatgatccatcaaacataacggagctgtagccggcatcaatcgccttgcgtatctcatcataatccctggcatgatccagatgaagaacgacatcgacgccgtattcctcggccatggaacggcagactgcgacaagatttctatgcccgacataattggcagttccacagcttgtctgaataataaccggggttttctgatgtactgcagccttaataatggccggcagcatctccaggttatgcgtattgaacgccccaatcgccatgtgcagcaactctgcctccttcagcacttcctttaatgttgtatacataatttcctcctttaataacctgtatgcaatggagaatctgcatcctccttttgtggtgatcctgtatatccagcgttaactttctgaaatatacgaatatcataatatcaaaatatacgtacgttttgatttacaagcacattatacttgattacataaaaaatacagcgctttcacgctgaaaacacattctgaaattgtgataaatagtaaaattcatgaatggccattcatggtacaatgatagagaaaacacacagggaggtaagcatatgtttatacaaattgataaaggtatatatgaaaagctgtcagaagcggagaagggggtcattcagtttttaaaccagaatgaagaaaagattccctatatgagcatcaccaatattgcagagaaaaccttcacatcacaatcaacggtatccagagcgattcagaaatgcggttatcaggggatttcccagctgcgctatgcgatttctcagcaggagcagatgaaggagcatcacgaatccagctatggagtaaataatatcctcgcaaaatcatatcgggaaagtacaaaaacgattgataatatcagtccggttgccatgctgaaaacaattgaatacatcaagcaggcaaagcgtatattcatctttgccagaggctttacggcattgatcgcagaggaatttcaaatgtacctgcagctgctgggctacaatgccatcatcgttaaggatgtgaaatggatggagaataccgaacgcattgtcacaaaggacgatattgcctttattctatccctgcgaaattccacgccggagctggcaagaagcgccagagctgcaagaatgaagggtgccaaggtgattacctgctgctgtaaatctccctgtgagctggagaaattttcagatatcacgatttacggccattccgagcagatcatgaaggtcagtggaatgacggtgtattcaaggataccgctgctgatcatcacaaggacgattattgaatacatcgggcagtagagctcataacaaggtggtattcacacggcatcgagtaaacggctgaaagctgtcacatcaaggcttttacagattataaaaaacggatattcattttctaatccttaacccctgcagggtgttcatcaggaaacaatatgatataagaagcgcaaattcccggtgttcttgttgatttttccccatgaggatgtaacctaccctgtcatgaattagcatagctttcaaaaggggctgtgacgagtaagagaaattagtgtttctctgaaaatcacagccttttttattatgatttttgtattttgggtacactgaaaacaactttttgagtgaatctggttttaggcccttttttcgttagaaatcccccatcccattgtggaaaactaattcagtttgcttacatttctctgcttttctctttttttatcccttattttataattatggtactttcttatgttatatccaatacacactaagcttagttctaccttgactccgctttctcctcgtcgatgcaagcggacatattcaaaatcttgtttgatgtccgcaaacgctccctctgcctgtgcactacgatttctcatcaatctctttccttcttcactctttagacattcatctatctctttatgcatcttttctaaggcagggactatccgtgcacttcttccgttctttgatgtcgtgcatttgctcctgtgtggacattcaccgcagtttttatttctgtaatacatcgtcgtttttggatattgtcctttgatattgagtcctattcgctctatctcaaatacatgtccggctggacatactggagtaccatcctcttgtcgttccatgtgccgcagttgatagcgattcttatcatttactttctctttcttcttttcatatccactgtatttcaatagtcctttaatccctttacttttgcagtaacagtaattatcatagctcccatatcctgcatccgttacttctatatcagggtattttccatataattctttatatccttctgtaaatggttgtaacgtttttatatcatttggatcactacttagatattgataggcgatgtacccattatttactcctatttgtacgttatatcccggtttgaatacatttgtatgattataataatcatatttcatatgcatgaatgtggcatctggatctgtcttggaaaaactgttcctgtcttccaatatatcttcctggattgcatactcccacatctttactgcacttttcttcaattcatcgcacaattttgcgatttcgtgttttcctctgccttttcggatatattctttttccttcagccaattttcaagcgcttcatctattttgatcatatactcaatatttggatatttcaaaattgaataattgatattgatttcatgttttttaaagtatcgattcacttgttttaacagttccatacatttctgccagtgtctgggaaggtatcgtttactccaacctttccaacagaacgtcatcttattggcatttgcctcaaattttgtaccatcaatataaagaatctgttcttccaatgctttttcatcttgtacatacagatagatttctttcgcaatcgtttgaatggattctttcaatgtatgattgatgaatcgttcaaagctcttataacttggaacacaaccgttcgtgatactacggtaacgaatatcatagcgacaaagtttttccagttttcgtaaagaagcatagccgtcttcagcaaaggccatgaggatgatggtcaacatcatgacagggtcataagagcgagaatcaagattatggaaatctataaatttatttagattaatcctccctaagacttccaagatcgtgacgctcaaatcatcatcaagaacatcattttgaaaagaataatcaaaatttagtagcatatatggttgatatgcggtataatttccttggttaatttgagtacttgtcatacataaattataccaaaaaatacaccttcttctctatagaattgggtgtattttttatgtctgggctgtgacttatctgtcacagccccttaccataaaatataatggacaacgtgaattgaaaaaaatattatcataggaaagaacaaactgttatttccaagagtgaacgtcaggataaataatgattcctgacttttttgtaaatatacaggatgaggaagccgatgaggaaggtaagatggctatgacctatcacttacacaccgcctagcatacttatttctttacgatccgttttagagccgctatatccagaagcaaatttacagtctgaaagcttcctttgtaaaacactgcccagttattaaaaacacagggcacagcttttgctttttctaatgtatcaaccaaatgaaatgctacggggatatcatgcttttcacaatactgccttacgatatctacatttttcagtatatatggacactgcatatcatagaaaacagtaaggtcctgatttgtaattctctcttttttcgcagcttcacaaagttgcggaaatgtcccatcaaaggatagtgccagcagctcatagccgctttctgtagtatccacaacctgaaatccataccgtttaagaaaggactgatctgtaagccaggctttctgcttttttgccccgagaacacaaattccggattttccatttgctttggcgtctgcgatacagtattccaacagctgcttgccatagccttttcctttatactctccggtagcccataagcagtatatataataataacgacttccctctataggtacccaagcggtttcaagcggtgcatattcaataaaaacggttccctttacatttaattttctaaacacatgcccttctttcaaccgatctgaaagccattctcgttttgctgatatcccggaatgtggcttcctgctgcgtatgatgcagcatagatgttcatctgatacattttcctctgttaaattgataaagtcattcttcatatgtatcttcctccttatgtttaccttatttgttttgaatgagtatggcaaccacaatacataaatgcgtccttatgaaattctcatcattaagtttttgtttgtcaaacatggtgcagtcatatgcgtatgtgatgctcttactgattctgttggtctcaccgttatatgttaaatcttctctgcctcaaactgcttgtgtaattgaatgcataacagccatcataatgaaactgatcactgaataggcacactgcatacatatgatagcttgaatttacttttatcagaaaactgttttacgtatcatgtgcatagcttatataatacaattataatacagattgaaaatgaaagcttgattggagttgctattcgctttttcacaaacagatgtaaatccgattcataggaatagtaaatgctgatgatgattacattagcttttccattgtctccagattagctcttactattagataacatatatctatattcaattgtgcagaaaccatacctacgcaaaatctcttcttgtcatattatttcaattatatggtagtcagcctccattttcatacgcattgcgtatacaggatttttcaatctacaatacaaaaaagagtataaaacacatacgccttatactctttactcctatgaattaaaattacttattattcaagcctgatgcagcttgttcaaaattacagactgtaattctttttccacacccagcattttcatggcttcatctgcactgaggttactgaactgcatcagattctgtacatgctgaactgttgtattcacttttccctgttccagccccttcttgattcctctttcttctataaaatcgctaaagttacacatttccatgacctcgctttctgtctccctcttcatcattatcccatcctctttttctaatcgttccttctttttttccaccgaaaagtcttttatgaacagtaccttcaacagctccagcagcttctgctcacacgtcttcacaggattctgtgcttccctgtcttcctttccattctgaaacgcttccacctgcggatataccatgaccgctgtcatgatatcgaagtgatttcttggcgcatgccatatcttcgtatgacagctttcctgtatagtatatgaatttataacatcattcttttgcttcgcatgaccgatacatatccatatggaatagaccttttttatttctccatactttgaattcgcaaatccaagctctgcatttttctgctttgccaccactctactgctgcaatacagcgcacgcttaatcagcgaataccctggatttcctttgcctgactttccagattgatgatcaggcagagctactccttgtactatggtctcttttcttcgcttccttcagctttatatttgcacagcaaagctgcctcaaactgaatatcgtatttgatctgtgatcccggtatggcttcatccacaacctcaatgcttttctcatcgatcatttcactttctgtcgctgacaattcaatataggctggaatttcctccagtggtgtatcctcatattccggtatgcagcccttcatgacacaggcaagaatctgcttatttgataaaatccttttataatactcatcgtacacttttttattttcattttttgtaatagcagaagcaattcttgtagtctcacgcataatcatatcccttctttccttatttcatgatctcctagaagaatatgacccggtggtcctctgcttttgctattatttttatggtatatagcgtatttattacaatgtccgccgataatcagctgactcatacatcatatagaaaaaggtgtcttgtgttaaaatactatatgaacgcgaaaaaaagggtccattaagcggacatgcagaatggccggggcttttgtgatagtgatgcatacatcaacattatagtgtttggatattttctcatggaacagcccctccttttttgtatcatcagtgtatcacaggtacctataaatatacagtataatctttaaatctttcctaccctcgcaatatgaaaaaccagctgaattacacatatcagctggcatttttatcgtgaatatgctttatgttcaaggttccttcattcggcactatcagtatcttataaaagaactccttcttctctgccatcaaatcaactgcatccttcgtctttgctagcgggaaacggtgagaaattatagcgtctgtctgtataattcctttctgcaatgcctccagagaaatatcccaggcattatgtggaaaccgcttgaattcaaagctccatgttcctttgatggtcagctgcctgcgtagaatcgtttcatatgtcttcacggagacggttaaatccctcactggtcttccaacaggaccaaaacgcccgttctgctttaaaagctgcattgcctggttgaagacaacaggcgcaccactagcttcaaatactacatcacagcctgcgcggctggtagctttttccacgatttcgcgtacttcctctatcgaaccgcagacggcatccgttaagccaagctgtctggctatctccacctttttcggatccagatctacggcaaatacatgagatgccccaaatgcctttgcccactgtgctacaaatattccgattgcccccaaaccgaatacgacaacatcgtccccaaaattcacacctgtatttgataccacatgcagtgcaacactgattggttccagaaatgctgcagtttcaggctttacctgatccggcataataaccagattttcctcaggaacctttacgtattctgcaaatcctccatcgctgcgtgaacctagaaaatcatagttttcacattgagcgaaatctccaacctcgcacgatttacatgttctgcagggaatcaaaggaattacggctacatttttatgcagcaggttctgtttgacacagctgcctatagcaactacctctcctccaaattcatgaccgggaatcgtcgggaaatgataggtcccctgtgtaagaattctaggcaaatcggagccacagacaccacaggcggaaaccctgaccaatacatcatgttcatcaagtctcggtatttcaacttcttcgatccgaagatcattgattccatgcaggactgctgctttcatttttccttccatatgtttcctttctactcaagattcgcatgctttttccataacgcatgcaaatctgaaatctgctttctatcgacaataagcaatgcgaccatatctgcaagcaaaagcagactttgttcaaagaggctactcatgacctgtgaagatgaaatttcatcctccagctgcagctttgtactgcagggaatacggataaagatattctcatacggtgtcatagagctggatgcattgcttccaatatgtgcaattttcgcatgataccgctgtgcgatttttacaatagccaacggcacgacactttctccggagccactacctacaagcagaaggtcatgctctgtaatcgcaggttcatcaatcgccccaacataggttgcttcgataccaaggtggtttaggcgtttgacaaatgcctgcagcatcagcaatacacgtccaaccccgacaacaaacacggtttcagcctcacagattgcttcagccaaagccacaacttcatcttcctttacatatgtaaataccgtctgcagctcctgcagaacagtatcccttgcttctctatacttcattgcacatcaccctcttcaaacagcgcataaaatgccgcctcatagcgattcacatcagtttttatctgaacagagaactgggatatggaaaacgcgaaaagtccaagcaggaaggtaatgtcttttgctctggcatcgtccctgctgataaattcattcaatttcatatccagtgctgcgatttgcttacgatatgtgctgcaatagctctgtccggttattctccgtttctttccgaatatttctccttcatgatcttgtatgaattgtacaaaatcaatcgattttcgtgactgcatcatacatccagtgcagcactgtacaacgccttgcaaatcgtaacgctgtgattgtgtatatcatcaaacagctgcttgaggtccttcagcccggctcgatgtgtaatcaaatcggaaacctccagctttccttcttcaatcatttgcacagtatattcccattcattgattggtgtctgcgcatagaaggaattccatacaccatgcatttccagctccttacgaagaagcagggaatgtacattcagctgtattgttgtatccgcatggggatttcccagccatacgatggtaccgccaactcttacgatttgtatggcatcattgattccggcagagcatccggttccttcaatcacaacgtcaacgccgcgcccgtttgttatgacatcaatacgttccttcagattttcctttctggaattgataaccgtaaagccgcgttcctgtgcaaatttctgcttggcttcatcaatatctgtcaggatgatttgcgaagcaccaaacaatgatgcccagcgggctgtcataatgccaatgggtccggcaccgagaatcgctatcgtttgtccggcagtaacatttcctctgcgcagggcatgctgagcaacacaggcaggctcacacatactcagtgcttccaggtcgatattctcatcttgtgccaaaaccagatgccagcgggacggcagcagacaatattctgcaaaaccgccattgctgcgggaaccgagataatcataattctcacactgacagaactgtccgatttcacaaggctcacattccagacatggaatcaatggaaatatagcagccttttttccaatcagcgcttcatccttcggattccctacggcgcagacggttccgctgaattcatgcccgattacaaccggatatactctggtacccagctgatatactctcggtatatctgacccacagattccgcacgcaccaatccttacaagaatttcatctccttttggaaccggtgtttctatttcctccagccggaaatcattgattgcatgcaatctcattactttcattcgatattcctctttccttttctatctaccttattactttgcaagaatgttattcagctcaaaacgtttttcacttggaatgatctgaatcgctacatcaataccccgatccagaaaatccttgatacactgacgttcctcatctgttgcggatacgtttttatataccgtcgttcttcctgccttcatacccataccgccgatattaaccgccttgatttcaatgccgccatctaccagctttttcagactgagcggtgattttgccaatacaaagcttggcgtatccaatccgctctgcagcttatgcagtgcttcctcttccgtgagcgcaatcaccttgattccgctcggggctgcattctgcagtacaaacagcataaaatcatcctttgcaaccttatcatcgattacgataatctgctttgccggtaatgttttcatccatgcggtcataacctgtccgtgtatcaatcggtcgtcaatgcgaaccagtagtaaattttccataatacagctccttttttattgtctgttaaaacaaatggtaccgatactttccttagcttccttttctgccagagcagcgagctcctctaaagtggaatcctcatgtctgcccagagctacgctcagcagcatcggaagatttgcaccgacagtaagcataatatgcttctctctggtcaacatgatagaacgattgaacggtgttccgccgcgaaggtcaatcagcatgagcacaccatgtccgtcatccatctgatcaaccgctttgcacaaacgttcaccataggcatcgggatcctccccgggctgcagagcgaccgcagtacattgtgcaatggtcccgccaatcatttccgtactgcttttcaagccttcacaaaatacaccatgacttgcgataactattccaaccatgattttccctcactttatttttccaattcctgaacatatgcgttgtacatttcctcaaaggtatccagactgcggataatactcgatgttcccacgacgaatgcattggctcctgcatccctcatgagcctgctgttttctattgttgtgtttccatctacaacgatgtcgatttctttttcatatgcatccagaagctgccgcacacgtcgtattttctgcggtgcgtccggtaccattttctggcctgcaaagcccggattcaccgtcatgagagtgacataatcaagcagatccatacattcctccaaataagataccggtgttccaggattcaatacaagccctgccttacagcccttgtctcgaattgtctgcaggagcttatacggctgtgctgttgtttcgggatggaagctgatacgatcccccggctgaatatcataatattccatatactcctccggacgatatgacatgatatgtacatccacgggaagcttgctcaaccgcttgatatctttataaatcggcgttcccagcatgacattttttacataggctccatccatgatatcgaaatgcacggaatccagctgtaccttttcaaacagctccagatacggcttgtattcctctactttacagcacatgatagatggtgatatttttatatccataaacgttttcctttctacatatacgtatgcaatacagcaggaaactgtcatcctgtgtattgcacgatccaactttttaagctgctacactcagcagtcccagcagggatgccgctattccgattacaaagattacggcaatgataagggttggattcattttcttcttaaccatccaccatacaaacaatgcgataatcagcggaattgcgcccggcagcagctgattgaagatatcctgaactacgattttaacctctcccactctgaacttggcaggacagatcacattgattctggaatatgccatattcccgacaacagtcagtccaatgatggaaaatgcttctgtgattttattcagcgtaccgctttgcagcagcttgaagattgcctgttttccctgtttgtagccaagcataaagcaggtatagccacagccgatcatcaaaaccttatatacgacttcaaataaaatcggacctgcaaaattaccatccagtgccagactacagcagataccggcaagaatcggataaacaactgcctgtgaaaccgtgtccccaataccggccatcggacccatcagaccggtacgaagcgcattgatatcctctccgctgatatccgcaccgtttgctttctgttcctccatggaaacagtgataccgtgaatcaccgtaccgatccaggaaggctctgtattaaagaactccatataggttttcagtgcttccacctgttcttccttggtgtcatacagctttttgacaacgctcatcatcatgttcgtgttgccgagtgcctgcagacgctcatagttgtagcaggtttcgctggagtaaaccagtgcccacgccttgaccagatcctttttgctcagttcctttttattcataactgcattgctcatgattatgctcctccttcttcacgatctctgctaaagaagtacatgacagctgcgattacagcagagaaaataaacagtgacatcgtatccagtttcagataaaccgttgcaaagaagccaaagaagaagaacgcaatcagctttttctttccaaggtagtttaacagcatcgcaataccaagagccggcatgatcgcaccgacaagattcaatgcatcaacaagccactgtggaatcattgccagagtatcctgtgcccattgtgctccatacagaatcatcagcatcaccggaataccatacaatacaaaagacagaataccggaaggaacatagttcatcagacgtacacccttcagatttccctcctccagatatttatctgcacggtgtacccagacagagtttaaggtcatatatgcctgattgatcaggattcccagcagagataatgttaccgcaaagctgacagccagctttggatccgcaccagacagaacagtcaaggccgtaccgtaaatacctgcgaccatcagattgcccggcatggagcctccggctgtgatccagccaagataggtcagctgaatgtatgcagctgcctgcatacccaaaacaggctctcccatgattaccccggtaaggaaaccggaccagatcggatatagccaggttcttgtgataaggtgtgaaaaccaccactgactgccggttgccagcagtgctactaaaatcgctttaattagcatttgtaatgcctccctttttcaaaatgaatgtataatcgtaatcgacggatgtcgttctcatccgatacccatatgcccccgtcagtaccgaagattcacctgccttccttcttctgacacatacagccagaaacgaaaacgtttacatcacgtttacgattccgattttatcctctcttctgccacaaggcaatggatttggattggaaagctttactgatttttcgatgcttcttaaaatctgatttacgtgttcataaaatacatgataaataaaggggctgcgctgtctgtaaagattttcagtgctgttacagcatcgttttatctaaaattaactggaaaggctgaaacgtagttgctataatggtaaaaaagaaagaaagggatatgaatgattatacaaataagcaaagaagtatatgatagtctttcggattcagagcagcaggtaatcaattatctgaatgaaaatgagagcagcattccactcatgtcaatcacgacgatagctgagaaaacgtttacctctccggcaacggtttctcgaaccattcagaaatgtggatttcgcggtatttctgagcttcgttataagatcagcaagcgtgcagagcacacagatgattcttatgtagtgaacaaggtgttaaacaagtcctataaggaatgtgtgaaaacgattgataatatttgcgtaacgaatatactcaaaattattgactatatcaaaactgctgaaaagattttcatttatgcgcgcggatttaccgctctggttgctgatgagctatgcatgcagttgcagctgcttggctataacgcgcttgtcgtcaaggatgttacctggatggtaaaaaccgataagctggtgaattccaatgaccttgttatcattctgtctgttatgaatacgacaccggagcttgctataagtgcgcgtatggcaaagcgaacaggggcaagggtggttacctgctgctgcaaagagggcacaccgctggagcgttattctgatgtaagcattatcggttatgcagaaaccataaccagtaacaagaccattaccgtaatctcacgtatacccctgtatatcatcactcgtacgattgtggaatatctgacactttaattcgctgcatctggtgcagcgcttttttcttttccatgcatctcgaaaagcttttcagataatacggtattcctgttacatctgaaaacaatttcagaccatcaggcactatactgaaagtataaaaggaggtagcatatgaaaaaagaaatgcgctgcgcggtattcacaggacaaagagcagttgagcttcagcggtttccgattcctgaagtggatgatgataaattactggttaaaatcgaagcatgtggaatctgtacatgggaacaacgcgtgtttacaggaagtatcaatactgattatccgctgattggcggacatgaggtggcaggacgaatcgaggcaatcggaaaggatgtgcacggcgactgggaggttggacagagagttattgtaggtgtaacgcttccttgtcgttcctgttatttctgtaaaacgcatgaggaacaaagctgccagaatttcaacaccgcacaggttctcagtggtcagccatatcccggtaccggaggatttagtgagtatatgatggcagtcccctacagtgtgttcccctataccaatgtaacaccgcaggaggcctgtatctgtgaacctgtctcctgtgtcatccatagtgtggaaacagtaaatccacagtttggcgatgcctgtgtcattatcggggctggcattatgggacttctgcatacgcagctctgtgtaaaaaaaggctgttttgtaattgtcgttgacatgaatgaagaacgtttagaaatggcggcatccatgggggcacattacacgataaacccgcataaggaacatgctgagaaaagaattatgaagataacacacggaaggaaagcacgggcggtgttcgatacaacaccggcggcaagtgttgtagaagaagcatgccgttacgtcggtaacatgggaaaactgatgatatacagcggtatttatccgaataaaccagttcagatggatgcacactggattcataagggaagcattcagattctgggaacagcgaattccaatgaccgcgattttatgcgtgctgcatgcatgatttcagaggggattatcgatgttaagccatttatcagcggtgtttaccctgttgaagaggtatccagcgcattggcatcatcctgtcagggaaacacattccgaaacattattacattcagcgaggagctataaggaggaatttatgctggttacaacaaaagaactgctctgtatcgctaacgcagagaataaggcaatcggtgcctttaatattaccggattggaaaccctgcaggcggtgttacaggcagcggaaagcaaaaaagagcctgtcattcttcaatttgcacaggttcatgaggaggagcatattatgagtctggatatcattggtcccataatgatcatgatggcagatcaggcaaccgtacctgtagccgtccatcttgatcatggcgtggatcttcatattctcaagaaagctctggatatgggcttcacctctatcatgtatgacggctcctccctgccctatggagaaaatatcgcatatacgagaatggctgtcagtatggcaaaggagtatggtgccagtgtggaggcggaaatcggtcagatggctggtgtaaccctcaatgatcagaaaataacagaaaaccgtaagattgacagaagtatgtttaccgatccgctgattgcacaggatttcgtagaaaagacaggtgtggattgtctggcttgtgcgtttggcacggtgcatggactatatgcgacaaagccctgtctggattatgagctggtaaaagaactggatgcagccattggtgtaccaatcgttatgcatgggggaagcggtgtcagtgaagcagattatgatatcgtaatcgaaaatggtgtacgcaaggtaaattactatacctatatggcaaaaagcgggggagaagctgcaagagaatatgcagccgctagcgagcctgtctactttcatgatttagcaaatgcagcaatagcagctatgtgcagcaatgtggaggaagctcttcgtatttttgcgcatcataaggagcagtaatatgagagcagcagtatatttcggacgacatgatgtaagaatcattgattttcaggagccgcctttaacagatacaggggtaaaggttgccgtatcctattgcggtctgtgtggtaccgatctacataaatacgatggattgggtggatcacgtccggttatacctcccgtggttcttggacatgaagcaagtggaattgttgttgaaacaggaagaaacgtaagcggcattcatatcggagaccgcgtatgcgtcgatccgaactggagttgcggacattgtacctactgtcaggcaggaatgccgcatatgtgtgaaaacagccgcggtgttgtaaagggctttgcagagtatatatgccctccacaggaaaatgtctaccctttaccggatactctttcattgaagcatgcagcgcttgcagagcctttatcctgctgtctgcatggcatggatttgctggatgtacatctgggagatcatgttctcattgtcggtatgggggcaatcggttccatgatggtgcagctctgccgtcttgccggagctgctcaaatcgttgtagtcgagccgcagagcgaaaaaaaagaactggcagaagccttgggcgctaccatgtttttatcgccggatgatgatgtaaagggtatcctgcagaagcagcagcttcatatcaacagggtcatggaatgtgtgggattaaagacaacgattgaaaatgcgttccagtatgccggtaaatgtgctacggttgttctgtttgggctgggtgacccgcagcagcctgctgcttttaatcagtacagtgcttttcagaaagaacttactattaaaacaagctttgtcaatccacatacaacacagcgtgcaatcaatctgctggcttgtggagctatcgactgcgatgcaataataagcaaaatattggagttggaggaaatagtggaagaactgcaaacgcggaaatggttccgcaagggtaaggtacttgtatgtatacagccgcatacagaagctatcgtggattaacttgtattttctgaatataaaaagccatccaatcgcctttttctgactacttcagatgaagacccttatggatggcttcctttattatactctatagcttcttcatatttctgaagctatttcattagcctaagcttttatttatgattcgtcaagtccctcttccccattggattccattacacgcttataccacgcaaaggaatcttttttatagcgttttttgctaccacttccatcatcattgatatccacataaataaagccatagcgcttgctcatctgaccggtgctggcggctgtaatatcaatacagccccaggatgtgtaacccataacatccacaccgtctttgattgcttctcgcacctgaatcaaatgatttttaaagtattctatacggtaatcatcatgtatctttccatcaaccagctcatcatgcgcaccaagaccgttttctacaatcatcagtggaatctgatagcgctcataaagctgattcagaataatacgcaggccaaccggatcaatcacccagccccagtcgctggctttcagataagggttacggagaactcccagcatgcgctcatcctctgtcagatcactgaccttttccggatttaacggagtcactcttgaataatagtagctgaaggagcagaaatcaacgcatccctgtgcaagtactgcagcatcaccgtcctccataactattttaactcccttttcttcaaagaaacgatttgcataggatgggtacgctccacgtacacatacatcggtataaaggaaaatctcatggttcgcttcaatgctttccataacatcctctggtttgcatgtattggcatagcttggaatcgcattgatcatacaaccgattttcatttccggatcgatgctgcgtgccagctttactgtcagtgcgcttgcaaccatctgatgatgtgctgcctgaaacatgatctgttccttatgctccccttcttcaaattcaagacctgccgcataccatggaataacactgcagaaattgatttcattaaacgtgatccagtattttacttttcctttatagcgttcaaacagtgttttcgcatactttacataaagatcaatcagaatacgatttctccatccgccatatgcctctaccagatgcagtggaaattcgtcatgtgaaatggtgatcagcggttcgatatcatttttcagaagctcatcaatcacattgtcataaaactgcagacccttttcattgggctcctcctccactccggttggataaattcttgtccatgcaatcgacatgcggaagcacttcatacccatctccttaaacagtctgatatcctccttataggtgtgataaaaatcaataccgccatgggaaggataaaatacatccggcagaatcttatgatcctttggtaccgcctctctgctgccatgcggaagaatatccacaatgtttacacccttgccatcctcattccatgccccctcaaactgataggcactggttgcgccaccccataaaaacccttccggaaattgtttatcttttttcattatatctctcctctcatgtaatatgtattttcttcataaatgctgtatagctgtcacattccaatacctgtgcaaatcgaacaggatcatcaaatacattcagtatcagatcatacagctttggaacctgatcaaagctcttgtgcaaagcaaacatcagtacaatgttcacttcaaagccatcccatataacgggcttcctcagcagtgcgacagcgatgccgtttttctttgctgtttttttcgttgtatgcggaattgcatatcttgcgccaaagcaggtaggtgcaattgcttctctttcataaatctgttcctgaaaatcggcgtccacatacccctgttcctcgagtaagctgcaaagataggtaatcacctcatccttggtagtaagctgtgagggaatacaaaacaaatcctccttgaaataattatggatcatgatattttcataagactttttaacgcggacactctttacaatacgctcaattttctcatattcttcatcctgaagataattatcaagctgaaagacaggtactcccatttgctcactggttgagaccattgtcacaataatatccggcttctcggtataaagcgctttaaaatcaaacatggagaagcagccgatcatctcgacatctgttaaagcctgtaatctctgctgtatgatatgtgttacagaatttccatacggattgatcaatgcgatacggacaatggaggtctttatacttttgataccgttcataatatgcaaggcgataaagctgatttcgttttcatccagaacatagcctgtttgttcctgaaagcgtatcgctatatatgctgcgatatcatatataagaacaaagctctgcttcagctctgacaataatggattttttatcagcataccatgcttacagcggtttctcaaattttgaagatgcaatgccagattatccataagatcctgattttcagtaaaattgatactgtaaatatcataaatttccctcaatacttcatgcagaaactgcataactctcacatcatcctgtcctgcatttcgttttttgaacaatgcacaaatctgctgtgtaccctctgcagtgaattgaatacgcattctttcccttatcgcttcaagtaacggcctacagccctgatcacatatcgaagcacgatcctcttccatgcatatataagaggtgttactgatatacatcagcatatgcagcaggatggaaaacagattaaaatcagaaacagcaagctgctgcctgtggataaattccatcagtatctcagaaagcctatagacatccacattttcaaaataacgatccaatattccaacatcaaagcgctgatcctcactttcctccaataggaaataagtcaaaacccttcgtttttctatatcatcacaattcagaaagagatgattttgttttcttgtaatcctcagtgtccgaaattccttctgtatgcgttcattcaatatccgtatatccttattcagtgtagaggggctgatataaaatctatccgcaagctcatagtaatccacatgctcattgaatagaatttccttcagtatttttatatctcttctcccctcatcaccaacgatatagttctgcctgatccaggcatccttatcacgcactacatacccttttcctttcagagaagatatcatgcaggcttttgatttcctattgatttctgctatttctccgtgtattgttttctcactgacctttaaaagattggcaagtgtcgctgcagtacaatattcggattccttcagtagtatatcaaccatcttcatttgtcgttttgacagactgatctccatgatatctctccctttccatgttattgtttccaggtaaatgcgtaatcgtgattcatcagatatggtgtataataggcaaccatactggataacggcaggatatcctcatgcaactgaataccgagaacatcctgtatatatgttcttctttccagcatgcgctcccagctgtttggatactgctttttgatttcctctttcaataccgtatccgcaagaacaacgccgttttcacagcagcagcccggatatccttctacagatggaatgatatcaatctgcaaaagcataccgcttttcagcttcagccttgaaccttcgtaaatcgggctgcttagccattcctcatccgcagtgaggtgtccgggattcaacttccagcagaaaatatccttcggcagaatatcatcaaccaacgcatatacctctttcccctccataccgatatggagatgctcaagccatgtgcaaacagctgagaaatatggttttgcgattttctcttcataatctcttactgcggaatcaaggtcttctcgtttataggcggcaaacgctgctctgctggcaagaccacccttatacccgacggttagtgatattctctcccctgtctgtatcggcttgttcatagtatacagattggctttttcaaagcgtgtcccgctggaacagatggtcacaacattgtgtatctgaccttcggattccagcaatcctccgatttcagcttctgtttttcccggctccagagcaagcatcgcccgctgaagacctcttgctgcaaggagctgcccatactcataatgtgcaatttcatttgcattattgaccgttcttgcaccatcctttggagagatgaatatatccgttgcattgcttatcttcacttcacaagctttcaatgcttcaagaatgtaatagggtatgtcaaacagctctttctgtaaacggtagaagcctttccatccaaccacaccgagatgcataccgttcttaacgcctgccttagctaacacactttttagatcctcttcctcctgaagcggctggtcaggcagtgagaaataagacatatgcagaccctttgcaggtattcttgcatgcttggataatgaaaggacctcattccccagtagaagatatgcatcttcatttttatgaagaatcagtaaggcttcttcaaaacgcggtataaaaccggtaaggtattcaaaattgccaccatgctccacatctgcatatacggcaatacagtccagttttttctcctacatacggtgaagaatcttttgccgtctttcctgcatggtttcatcactaagcagtaccggttctcctgtctcctccttcggaaacggaattttatctaaaactacgttttcataacgctgatccatggtgattccctcctttttcacgactggtattatttttttctcttctgtcataacaagtccgtggtcagaaagcttcacgtacggacatacaagcaaattcaatattgtgattctggataccggattttccaaatagctgttccccagcttatgaaaggcctccgccattagttccacgttttgtgatactgtttccatacattccgtgctcatcagtccggcaacaggaagagccagagatgcaagaatatttccctgtgaaactgcacagaagcctccatgcatattcataacctcctgtacggccagatacccgttttcaggtgtatcataaaccacacatacattatgactgtcatgagagatactgctggcaacagcaccatgatcaataccgaaattctcgacgatacaaaccgccctttgtgtgcgtccatagcggttgaatactgcggcatacatttgttttttatccttttgaagcaaaacccttccatcctgtatcgggcatatacgtgttttcagatgggatgtagctatatattcagatgcaaagcttaggatattcagctgtgcatacggaccctttgctttgataaggaaatcctcctgcttcagggcctgcatttggatagtatttctgctgttcagctcgcgggtataagaggataaaacaattggcgatgtcagctgttccttcttgctgacaagcttcccttcaaagaatactgcatgcacctgcagatcctccacattattcaacagctccagatcggctgcatatccgggagcaatcgcaccgagatgcttacatccgctttcctgtgccacacggtagctcgctgataacagggcttcctccacaggcattccaagagatacggcttttcttaccacatgatccagatgtccgtattttccggtgacattacagcgtcggtcatccgtacagaagcatatgcggctgtaatcattaaattctttgcagacatccagaatctctttcatacgcccctgtgtgttagcctctctgatatcgatccacataccctttctgtatttatcaagagcctcctgtttcgttttcacctcatgatcggattgcggccctgcatttacatacgcactgagacggttcccctccataagaggtgcatgtccctgcagatagcctgcatgctttttagcagcaagcagcaaatcatgtatacgctgttctccctgcaaaactccctcataatccatcacctcacccagtccggctacacgcggatgctgaaagagtgctgtataatcctttgcgaacagttcagcattagaagattcaaaccccggaagacttggaacacaggatggaagtgtcagcagcatacgcatagggagatcctgtgaagcagcaagcatatactgaataccttccactcccattacatttgctatttcatgggcatcctccagtacagtcgttgtcccgtgcggcaaaaccatagcagcataatgttccggtacaaggagcgagctttcaatatgtgtatgtgcatcaatgaagcccggacacaaaattccgttcagctgtaatcgctgctttgaaggcagtgccgaattctttttgttatattccacatgggatataaacccgtcgcagatgtagacagttgcttccaggaattcttttgtaaatacgttgaagatgcggcacccctcaatagccagatcattctctacatttcccaaagccgctgcaataagccgttttgtatcctttggttgaaacgcaagcatggttattcctgcatttcgtcctgctgttcaatcagcagctgctgcttttcatacattttcataaacgggaagtataacagcatatctatgacaatcagaacagctacaagaatgacagccttgaaatccccggtggagaaataggcgccgaagatacttggcatattgaaagaaagcattgtataggtttttccaatcaatcctgtattcagacaaaggaatgctataactgcattaacaacagataccagagaacatggtatgaagaagataggattcagcataatcggaagaccaaatgtaattggctcagatattccaaagaatgccggtatgattcccaccttaccaacgacttttaaaagcttcgatttggagaaacacaggataatagcaagcgagagacaggagccgacacctccaatgcagatgaaatatacccagaaggcttcggtcaatattgctgtaggcgctattcccgccgcaagctgtgcagcattctctgatatgttcatcatcataatcggtcccaccagtccccagaaggttgcattatggattccaaagaaccatgctgcattgataataaaggtcataaggagaataaaccacgagctgtcagtcgctttgatttgcggcgctataacagagctgagccacatggcaaaggtggtatccatgttatggaagatgataaacattaccagatacaacgacataatcaggattgcgatggataaggaggcaaaggtttcggatagggatgcaggaacactgtccggcagcttgatgcgcccaaagttttttgatttaagaaatctgtaaatttcaaccgtcacaatggaaacaaagattcctaccagaagaccttttccatccagaaagttcaaatcggtaagagatagcccatactgcagtttttcaattctcactgccagcatgaatactccgaatacagtgataaagtttggaatcaattcctcaattttataattcttacacagataatgtgtaataccaagtgcaacatacagtgtgataaaaccaagacttaaaactgaaatccatgagaacacatagctgtaatctgccacaaagccagcccatgcgagcagaaaaccgttcgttgtctcttttgtgacgggtgctgcggaaataacagctgacaagccgccgaacaccatgattggaaggattgtcataaacgtattacgcaatgcaagcaaatgtatctgtgtgcttagcttaccagaaaattcaagtactttcgcctctattctgtccttcatactttccatttttattttctctctttcataatttttttaacatcatcaattacaccctttgcattcatcaatccgtaatgtgacggattcatgcttacaaccggaaccgacgcatcaacaaactttttgattcgcgggatttcatgacgtatttgcggtccaaccagaatcagatcacacccctccaggtagttcatgaaatctccatcaccgtatgcctcaacataacagtaaccatcggatttctcattcattttttttgacatcattgctgtggacatgccattgttacataccagaataatctttaacatgaagtatcatcctttcgtttcactcatacagtgaaataactctcttgtcatctgataaatgatttcactcgccatcatctgatcctccgcatgaaccattaacagactgatctgatcgaattccccatttgcagattgcttcagaatcctgctgtgtgcccgctttgctgtatagagattttcctcggcatccttgtactgctttctgccagcttctttatcaccatcacgatagctttgcaatgcttcaaagcacagcgatcttgcttccccgctataggaaatgatctgcatcagggaaatttccaattcttccattgctatgcctcctttcatgttcagtatagcaccgccggaatttctttgttttcttttacttcagctgcaagaggaaataatgtaatactatgtataattatgtatagaaggctgtggctgcatgctgataatcaatacacagaaagaaacaaaaaagcagcccgcccctgtatatcggctgctgcttcttccctgtccgtatccgtttttattgcgtttctctgtacatctttatatttatacgatttctttcaaatcgtcaagacttttcagtatataattgcacattgcctttatttccttagtaggctgtactttatccggaatcataaccactgtggtacctgcaccaaacgctgcccgaacaccgtttaggctgtcctccactacaaggcattcctgcggtgaaagattcagctgctgtgcagtctttagatatacatcaggagccggttttccgtgtgtaatcatttcatcactgatgatagcttcaaaataatgctgaatacccgcattgttcaaattaaattccacatcctccgctgaagcactggttgccattgcaatcgtatacccttttgccttcacggtatccagaagtccctttacatcccccatgagtggtacaccatttttcagcttctcttcttttttgaactgtgtatgaagactacatgcttcttcctgcggccagcccttgggcatataggaatcaaatacaacctgctgatcctttctcgttcttccaattagagataaaataaattcatcgcttgtaggaagctgaagggtttctcccacccttttccatgccttcatggaaatggtttctgtatcaaagagtgtaccatccatatcaaaaattatcgctttccagtttctcatagcttttcctccacatcaaaaagccctatagctgtctatagggacttaatcatcatcgtcattatttttagccggcagcttaaacacctgttctccaggcttgctgaccatgtacttacctctggcaaaccgcttcacatattcaggattttccagattctgcttttccttggaaagatcatccttttgattttccagagagttgatcatctcttcagaagaagtgatttcatccttcagcttcattgtcatcatcaaatcggagcttgcggcataaatcaggaagcatgcaatgaagatggcaacaagactcaaaaacgtcttaagcttatttctttttttctttttatcctttgccatgcacatcctccttattcgctgtaaccatattataagcagagaacagtattttgacaaggcttttttcctgctttataatctgggtttaaatagttttatataaagtttcataaagactgcattttgagatatactatctgcagcagatggctttcataccttattcagcatgatttttttgcataagctttagatgagcagaagtttacccctttcatgcggaaagcttatctatttgttcacccttatttttaacaagaaatttacccctttcataacgttttacatactcctggtccttcagctttcctttttttcgacagctctttttccgatgctgctcgtcttgatttaccattgcttatcagggtatcctgatggaaatccatatgtatagtttatatgcaagatttgtcatcaagccgttttccaagacttccgcctggatgaaatttatggaaatccgatggattgaatccgcgttttttggaaatggcacaggcaattgcatcaccaagaaccaaaaccagagttgtggatgaagttggtgcaagattgtatgcatctgcctccgtcacctttggataaatcagagtaaggtcacatgcttttgccagtatagaatccctattcgcacagcaggccactgtcatacagcctatgctgtgcagcggcgttaaaacctgtatgacctcctgtgtagttccactgttggatatgagaattacgatatccttttcctctatcattccaagatccccatgaacactctctgtagcatgaacaaagaatgaaggtataccaagcgaagcaaatgttgcggcaagttttgcccctatatgcgctgattttccaacaccgcagaataccacctttcccttacattcctctattgcggccattactctttcacattcctgcagagacatagctgataatgcatccagtgctgttttttccctttctattgcttctataagatattttttcattttaacctctcaatagcgtcatatgtctttttcaaacgacatagaccatcctctaccttgcttctcgaacaacctacatgaaatcgaagatgctgtttagctccgtagacagtcccggacatgatagcgactttcccttcatgaatgagaaactgctgcatttgagcatccgaaataccaagttcatgaaaatcaatccatgcgaaatagcagccttcgggtatctgaaatttcagcttcggcatatgcttctgtatatagctctctgtgtacttaagattatcatataaataagagcataaatcatctacccattccgcacagtgtcgatatgcttctatggtagaaagcacccccagtatagctggggaattaacaaactccgtatacctcgtcattgtttcaaatgcctcataaattttgaaatccggaagtatcacataggaaccttgcagggaaggtatattgaatgtcttggatggagaggaacaaatgaaacaacgacagtcagaagcaagcttcagtacaggaatccctttttccttatacgtgatatccatatgaatatcatcgctgattactgtaatatcatatttctcgcaaagctgtaaaagcttttgcagttcctgttttttccatactctgcctacaggattatgcgggttgcaaagcaacagaatgcgtgcttccttgcatttttcttccacatcctcaaaatcaatttgataataccctgcattctccagcagttcactgctaatcagtctgcgctgattattttcaataaccttatagaaggaatcataggccggtgtgaatactaaaacaccgtcccgaggctcactgcatagctgtagcagctttgctatggaatacataacgctgggactgtaacaaatccaatctttgctaatcatacagtcatagcggctcgcataccagtgaacaattgcggatagatagtcctcatttttccagcggctgtagccgtatatcggatgctcaatccgctttttcaacgtatatacaaggctctttggacatgcaatatccatatccgatatggtgaacgggagaagattgtctgttccgaaacgatcttcgatataatcccattgtgtacaaaaggttcctcttcgatctatgaccgtatcaaattctgagccgctcatgcctgctgcatctccatcgctttgtttatttgcttacgtaaagcataaacctgtgtacccacaatcacctgaattgtatgctcatccaaatgcacaacagcaataccgcctgcattcttaattgcatcttcatcaatcagattaacatcgtttaattccagacgcagtcttgtaacacagttatcaatggaaacaatattgtcctttccacccagtgctttcagcatctgaatacctttataggatgaaagtgccgcaaagtcatccatatcctctgtatcctcttcactgatagccataacctcttctctcccgggtgttttgatatcgaatcgctggatagaccatttgaatataaagtaatacagtgcaaaatagaatgccgcaaacgcaatagcaatcggccagccagttctggtaccacgcaagacaccaaatgtaatgaactgaatcaaatcaccggtataacccatgagcacgccaagatacggcagaaccatattggcaataccatttaatacagtatgaacaaaaaatagcggaggacatgcgaacaggaataagaattcaataggctcagagataccgccaatcacgacagttaaagcgccggttatcagcagacctttgattttctttctattctgcggctttgcgcagcgatacattgccaacgccgcaccacacagtccgtattgaatcatcagcttgccttgttccattttgcctgccaaatctaatggaatatccatattattagctacataagcaagaaacatattaaccgttcccatatattcctgaccattgataatagcagttccgccaattggtgtaaagcggaaggtactcgttaccagatgattcaaaccaaacggaattgttacacgttcagctaccgcataggagaaataaccaatcggtccggaggtggatatccattccccaattatcttaaagaaattgtaaaatggctgccagaataaaggtaccgctaccatgccgaaaattcccatgatcaccaacatggcaatcggtgccagacgtggcccgctgtaaaaacctagcgcctccggtatttttacctttgatattttcggatatagccagaataccataagtccagcaataataccgccaagaacgcttgtattatacgtctgaattcccagaatcatcccctgccctgcttctgtcattttatctgcagcagccagttgatccgtaattgtcagatagaagtttgtaccgatatgcatagccataaaactaactagaccggtaaatgcaccaaactctttttcctccttcagtagtcctaaaggaatcgccatcgcaaacaatacccccagattattaaaggcaaacaagcccagtgttgtcataaagctgaaaattttctgcagcacaggattacccagcaatggaaccgcctctatcagacttgaatttgtgaatgccgatccgattcccagcagcataccgcacacactcagtaaagcaattggaaacataaaggtttttcccagcatttgaaagaactgccaaagactttttttcttattttccatacattttctcctttttatacataactatttttctaattcatgcagctgattcgcctatatcataagtaggactttattcttcctgcttactgcacgaaaaaaagacccatatctgcaccctcgtccagatgatcaggtcttgcctttcgtaacaatcctaatttaatattttcagtatatgtaccatgatgtagaacagctcctgtctgcccagctcatagtcataattatgcttcacaaaactttttattctttctaaacatgatttcatttcaggattcatttccagcatcatacgatacattttatcattgaaatcctgttttatatgcgtgcggtcaactgtaaaaatccgctgtcccagatacttcagatgcattgcaagacgtgtttgatcgaagtccttctccttccagtcaatatgcatcgtaacctcaataatatgtagaatctgtttactgaaggtcaatatttcttccgcactgtttttgtgatcctgacttctggaattgatgatatgcatggcgatgaagcctgcttcatcgagaggaaggtgaacccctgtcttcaaggcgatatatttcaatgcccacacaccgatctgatactccttatgatacagtgttttgatttccggcaacaacagattaggaagatgtatcccctgtttttcacgttcaatagcaaatgctatatgatccgtcaataacagcaccatctgattgtttaaaccacccttgaattccttagatgtttttttgaagatgatttcagaaaattcgaagtattcaaccggtatattttccagcatctgataaaatcttgttctttgtgtattctcaatcagataccttttttcgatttttctttcatcaatctgatctccaaccgccttgtgaaatccgatacccggaccggttactatcatttcagttttatcctgggaaatcgtggccacggtgttgttattaaaaatttttgcaattttcatactactctccctttcgataaaaaaaggccatccctgtcagtcccccgacatcaatggtcttgcctttgcagtaacaatcctgtatctgtcttcattataaagcgttttcaatatttgtcaatacgtattttttatttccatatttttctatatactcgactatatgaataagcggtttgctattgcaacgcagaaagcataggaaaacaagcttaatttataaagtgttacttcgtgtattacagtataattttagtatcatgatgactatatgtgcttacagaagaataagaagtttttacatagcaagcataaggttacttatcccttgattaaacaagtgccacatatactatttaagatacctttttcaaaagatagttgacaaaagggctgcttgcttttatcatgaatatgtattatttaacatgtgactgttaaatcaggcatgggtctctgcgtgagctcatgtctttttttagcagcaggaggtaaatgaaaatgttcacatttagaagaaaaaaacaaagggagctttacgctcctgtaaatggatgcggtattgctctggatgatgtcagggatgaagtgttttcaaaaagacttatgggggatggctgtacattccttccagagacaacgagcgtatgttcaccgatagacggtgatttaattcttgtcgcagatacgcttcatgcttttggtgtgagaagcagagaaggaattgaactgctgattcatatcggtctggataccgtgaagcttcagggaaaaggatttcaggcattacagtctgtcggtacaagcataaaggcaggtacaccggtgatatcatttgattcttcctatctgcatgatgctacccttgatatgacaacgatgctgatagttacaaattgtgcaaatctgaaaatcaaagagattacaaaggggtatgtcaatacaactgatcccgtaatcattatggaatgataatcatatatcgttttaccgattcttttctactggcataaaaaaactctgcttgttcttcagaaagaattaagcagagttattcgccatttgtatcttcgctgctgccaccgggaagtttaaaaacctgttcacccttttttatgacaagaaatttaccccttgcataacgttttacatactccgggtccttcagcttttccttctgtgcagacagctcttttttctgtgaagacagcttattgatttcactgttgtttgccgagatttcctgcttcagattcagcatgacaataacatccgtgcttgctgcataaatcagataacatgaaacccctattgcgagaagactaatcaggattttcatcggatgcttttttatttttcttttttttacggctgcttttttttcgttttgcattcgctttcctcctcttcctgattttgcctggtaatctaattatagcaataattttcgatttggcaacgagaagtttcactttaaacggatgcagcagcctgcggatggctgtgaaaagctgcagaaacacgctgagataccatgtaaaatagataaaagcacctagaataaaaaaacagatgagatagatattcgttataccgccattgatcttatacaatccaataaacataagggatgtaaacagaatatgatacaggatctctacgattccttttaaaatcggaaaacggagatactttacaaagctgattaaaaaactgaagccgaaagcatatacccatcccatcagaaaatgatagagtattgcctgaatctgtgtaggcagcagcattatttaaagatttttgaaatcactgattcctttccgtttccctttttattggatacataggatagagcttcaatgacaccgcgtattacaacatctccgcgctctgtatccagcttgcccaaggttagatcctttccctgaatcaccatccatccctgtgctgtttccagcagaaactcactggaatcaaagctgtcaatctgtttcactccggtcagctccatcaccttgcggtccttaataattacgttatgatatgggttcgtttcaaaacgaagcggattgctaatgttatcttccatacaagactcctccttatttctagttcattacaatctatgtatggagcagagaaaatagaacagctgtataaaaacaaaaaatattccggcttcactcttctgccagaatatcttttacttcttcctttttgatcagcttttcttccacaacctcgaacatcagggaagcatcatttttatttgcctgcttctgtatcatcgttacagtaacagtcagctcacggtatccgaatataaccttgatggtatctcccactttaacatctgtagaaggctttgcgatttttccgtttacatacacacgctcctgatccgccagctcctttgataccgtacggcgtttcagaattcgtgctgttttcagatatttatcaagacgcatcatactcacctctacgataagtttaccatttattgctgctgttggcgagataaaagttgtacaaatgcctctactgcataaagctcagacttctccagctccttcttatcaaatacgatgatgaaggaaccataccagtcaccgtaagcagtaaccggatagatcagccccttataacgctgtgcactgtcctcatagatacgttcattttcaaaatcctttaaccgatgtgtctgtgctatcataagaaaatggtcatgtatcttatgctctgttttcaccatacattcatccttcacaaaaaagacagtattctgatatatggcacgcagggtatcacacatgatcatgatttcttccatatgcttggacatgacatcgaatttctgaattacaattctatcattatcaataaagaattctatggaatctccttctttcatgcgatactgctttctgatttcttttggtatgaccagtcttccaaggtcgtcaagacgtcttacaattcctgttgctttcatttatagacactccttttcttcaagtagtatggacatttgataaacgctttatacctcatgtcgaaaaggaaagggatttcattttatatcaaattaccgatcatattcatacacaaagtgcatataaattatcggaattgaaggtatttttttacaaaactaattgttataacaaatataactatattaaattaaccttttatacataaaaacatttagaatgtaagtgtcaatagaaataggagtgatctgacatgacaatgggacaagtatgttgtgagcggattcatgatctgtgcgacgagagaaaaatttctctgaacaaactcagtatcatgtgcggaatgacgcagtcaacgctgagcaacatcacatcaggcagaagcaagaatccaaccgtttccacgattaagaaaatctgtgacggtctggatatcacgcttgttgaattcttcgatacagacgttttcaaaaatctggatcaggaaattaaataagctgtttgtcagcctgaaaaaaactgttatgggaactattcatgcaatcccataacagttttttctatttacctgtttttattttacatatgccttcaggcgttctgccggttctgtgctttcccacttcacctgcagatcatcacggccaaagtgaccataggctgccagatttctgtaaatcggcttgcgcagctccagtgtcttgataatcgcagtaggacgcaggtcaaattccttccttacaatttctgcaatttcttcatccggaagaacaccggttccaaaggtatccgcaagtacgctgaccggctgtgctacgccgattgcataggcaagctgtatttcacatttgcgggcaagacctgccgcaacaatattcttagcaacatagcgtgccgcatatgccgcactgcgatccaccttggtaggatcctttccggagaaagctccgccgccatgacgtgccataccgccgtatgtgtctacgataatctttctgccggttaagccgctgtctccctgcggtccgccgattacaaagcgtcctgtcggatttatgtatacttttgtttccgcatccatcatatccgcatctactatcacatcaatgacatgcttttttaaatcctcgcgaatcgtatccagagaaaccgtatcggaatgctgtgtggaaattacaatcgtatcgacacgctttggtcggtcattctcgtattcaacggttacctgtgtcttaccatccgggcgaagatactccagtgtaccgttttttcttacctcgctgaggcggcgtgccagacggtgtgcaagggatatcggcatcggcatatattccggtgtttcatcacaggcatagccaaacatcattccctgatcacctgcaccattgttttcctcaccgccctcctttgtttccagagagtggtcaacaccgagtgcaatatccttggactgctcgtcaatggatgttaaaacagaacaggtggttccgtcaaatccatatttcgctctgtcataaccgatttccaaaacaacattacgggcaatgcttggaatatcgacataacagctggtggaaatttctcccatgatcataaccatacctgttgtacagcaggtttcacaggcaacacgtgcatccggatcctgtgccagaatggcgtcaagaacagcatcgctgatcttatcacagattttatcaggatgtccttccgttacagattcggaagtaaaaaactgtttatttaacataatcgtttcctttctttttacaaattactatcattcttattttacatctttccctataggtaaacaagcacaacatagggaatgttgcatttcgtgtacaatgcagacaccacagcactgtcggtgtatcacgaaagcgcctgcatgggtataccagcaattttccttctatatcttcttatcgctgttcaccttacttcagctttagaaattcaggcgcttgctttgttgcagctatacgccgtgttttatgcagtgttgtctctgtcgatatccggttatattcctgctcctgaatatcctgagatgtacgatagcgctgtttcatatctgttttcaaaattgttgtttcatcggctgtataagacagcttcagctcttcaaaatgaatatcctcctgcttgtttcccgttttatttatatacgcactgaatttctctttgtccgtcagctctactgtatataccgtgtttgcatcctgctcctgcttctgatagcgaaagcagtccttcgcctcctctatatatttctgaaaaagcagtgaggatagaaatttttccttatccttggatgtggcaggtgtttcctgcattttctcataggtattgtcatcgttcacaatatatacatgcagtatgtcatccttcagctgtaaaaccgtatctattccgcttggatcactggtatccgagtggatccgcacctgatactgtttcagttctttcttctgaaaagcaatatctgtctgtatggtatcagtatcatgattgcgtttttcatccatcattttttcatctttgaagtattgctgtgtactgcttatatcttgtgtatcttcgatatgtaagccgtttgtagctttcagcatatcaattttcgcaaggatttccaagcgtatgttctcttcctttgcatgctccttctgcacactgcagccgcaaaggacagcggcagcacatagaaaaattcctatccctctacagttcatatcctacctcattttcaggaagctgtttgttcctctcccattggctcagtgcgttccagcacctcaatcaccgtatagagccagtccttgagctttggcagcttcatggtaatcttaccattcgtatagcgtatcgttatatttttcgatatggttgtcatcatttcaaataatgcaacaccgtcaatgctgtttgaccaggcacttgtaaacgtcagctcaacagccttgggcagttcacggaaggcatcaacgtgcggttcattgatacagatatccagccgcttcttttcaaataacagctgtacagccttgggcagctttccataattgtccttgatttcatccatcatggcaagcagttccttcttggaatgaatgtcctccatgcgttgatacagcgtgattttttcataatcctcagtcgcaaaggtgcttggtatatacgcatcaaccttgacattcgcctttgtcatttccggctttatctttggctgaatgccctttttctccatgatggcactgttcagcatttcaatatacatgtcaataccaaccgtatcaataaagcctgcctgctgcggtcccagcatatctccggcaccacgtatggtcagatcgcgcatggcgattttatagccgctgcccagctgggtgaattccttgatggattttaagcgcttcatagctatctcgcttagttgcttttgcggggaatacatcaggtacgcataggcaagccgatcacttctgccgactcttcccttaatctgatacagctgactcaatccgaagtggtctgcatcctcaattaaaatcgtgttggcattgggaatatcaatgcccgtttcaatgattgtcgtacagacaagcacctgatatttattatccgtaaactgcagcatgacatcctcgatatcctcccgtgtcatctgtccgtgtgcaacaccgatttccacctccggcattgcatcccgaagctttcttgcaacattgtatatttcctttacattattatatagatagaacacctgtccatttctggcaagctcccgctgtatgatctccttcaccatctgaaagttcttttcaataacataggtctgtaccggcatacggttcataggtggagtttccagctgtgacagggaacggataccaatcagtgacatctgcagggtacgcggaatcggtgttgcactcaatgataacacatccacgctgtttttcagctccttgattttttccttatgctccacaccaaagcgctgttcctcatcgatgacaagcagacccaaatccttaaatataatatccttggatagcagacgatgtgttccaatcaggatatccacatttccctctttcagatcctggatgatatgcttttgatccgaaggctttataaaacgattcacaactgcaatattcacagggaaattgcggaacctcttcataaaggttttgtagtgctgaagtgataagattgtcgtcggacacaggaaggccacctgccgtccatccgcaactgccttaaatgccgcacgggctgcaacctctgtcttcccaaagccgacatccccgcataacagacgatccatcggcttcgcagattccatgtcctgcttgatttcctgtactgctcttgcctgatccggggtcagctcatattcaaaatcctcttcaaactgcttctgcaaaggagtgtcctttgcgaatgcatgaccgatattctcatcccgtgacgcatacagcttcaccagacgatccgcaagctccgcaatcttagcactgacctttttcttcgtcttctcccattctccgctgcccagcttattcagcttcggacttgccccctccttggacacaaatttccggataagcttaaactgttccagtggaacaagcagcacatcatcccccttataggcgatatgcagaaaatccttatgtaccccatcgatctttttattcacaatccccagatattttccaataccatgctggttatgaacaacataatctccgacattcagctcctgataatcatgcagaacctccgcctctttgaatttattgctgtagcgtgttgccttttttacgctgtgaaacaattcctttgcggtatagacacagatttgttccttcagacaggtaaagccctcgggaagactggcattcagaaactgaatccctgtttccagcgtatccgatgacgttaccgtacgccaggatacatttgcctcctccagcagccttttcacctgttcctgctccttatgctccagagcgagtaaaacctttcgctctcttgcctgatgcacaacctcctgcatcgtacgttccagattgatatcccccagtgacatcgtcataatttgcgaggtgattggttttttataatcgacaaactgatgaaattccataggactgtgctgtttaaaggagctgtttaaatctgcgaatacatcaaagctgtgcagactgattccctcctgaaagagctcctgaagataggctaccatttcctcatgcatatgcttgacactatcctgcacttcctctacgctggacaggataatctgtgcatccggtgcataatcaaagaccgtgcttctgtttttcaaaaaagcataatatttatagaaccggctttccatcatgtggttactgatcaaatccaaatcctcattcacatgctcctgcagcagcttctgcatagaggaatcatgctgggacagctgttttttcagttctttgttcgcctgctccaccaattcggcaatctgtgcatctgtaaacagcagatcactggcaggaataatcatagcatcgtgcacaatttcaatcgtccgctgtgtggcaatatcaaagaagcggatgctgtccacgatattatcaaagaactctatacgcaaggggtgatcgtaattcatggaatatacatcaatgataccgccacgggccgcatagcacagcggctggtcgacacggctgacatgcgtatagcctgcttcaaagagaagctgtttcaaagcctcatattcaatttcctgatcctgctttaatgtgatgcagtgctgcctgaatatttctggagatggaagaaagcggattgctgcggctgtattcaaaaccgcaacataggcatcctgctgctgcagctttgccatcacctccatctgtatcgctttgttttccggtgaggcggcaatcgcttctacgcgaagggactcctccaacgagaaaagcagcacttcatcccccaggagggcctgcaggcgctcgtaaagtttctgtgctgtataggcgttatttttgataatcataagcttctgcggtgttcgacggtaatctgccgccaacagaagtgcttcctccatatacgaaagatttcccaaaacactttcttttctctgtatacttaaagccgcttcattttgctgcagttcctttaaaaggatatccatatgcattcccctatttccggttgaagtggctcatggtatccataaaggaatgagaacagctgtaaattgctgcatccctggccaattcaactgcctgcttgtaatcttccagttcatccttgcgtatcttgccgagcacccagtcaattaccggaattcgtgcatccttgccaataccgacgcgaattctgtcaaattcctgtgtaccgatatggcgtatgatattcttcattccgttttgaccaccggcactcccctgtgcacgcaaccgtatttttcctaccggcaaatcaagatcatcataaattacaagcaaatcctgtgctgacagcttgtaaaagtccatcgctgcacgcaccgcttccccggacaaattcataaaggtttgcggcttcatcagaagaacagcctcccctgcgattctcgtatttgcaatcagtgccttaaactttttctgtgctatatcaacacggcactcctctgcaatggcatccagtacgcagaagccggagttatgacgcgtcatttcatattccttaccgggatttcccagtcctacaatcaatttcatgcaatcacctcaatttcgcttcctatattataccaaaaaagcagagaattacatcctaaaaagcctgttttcgtacaggcttgctatatgcttgtatttcttaggggatgagacaggaacaaatgctggctttttgcatgcttccatctgaagattcgttcaacctgcttccatgtatgctatgtgatgtcccacattatggtttcttcttttcatccaggtacgtttcaggtgcaatattcttttttaagtccttttgcttttgatttgctgactgttcctttgtatcgtcctttacaaaaaaatctttatgcaatataaactctgtccgttttagctttttatctgtcatgggaatctcctcttcttaaattccaacaaatcattcttcaacctgaagctcatacagtttttcgcattcccctgttttcagattttttctgtaatatacggaggactttagcctgtatcccgttctccaccctatggaaatggatgcatccggaacactgtgattcacgctgtaataaacgacatctttttgcacatctacattgcggatatcaacgtattcattttcagaagaacgtctgtgataatccttaccattggtaagcagcttctctctggtattgtttcgatacatccaaatatttccgttatcatcctgaaacggctgattgatccttccatacttcatgatttcccctgtttcaaatactgcaaagttaatgggagcttcccccaagaccttgaaatttgagccatctttatttaccttggcaagcacaccgccctggtatacagatgctgaaccgccatacgtaccacacgagaaataaaccgtatcctgcacaacctgcacgcagtcaatatataaatttgcccttgtaaggtcagtccggtttacagcttctttccttacgtctgccagcatgtgccgctctgtagcatcaagcttcacggatgcaagcacaatatgcttgcccgtatcctttggattctctgtgaaataaacggtgtcaccatctgtatatagatagtgtgcatccttctccagcatctgtatatcctcggtttctgtattcataacatagatttcagtttcttcgctgttggtgagaacaagacatttatcatatactgcatgcacttcgtagtcaccatagacatgctcgtccttcccctgcatattcaatgaaaacaattcccgctccttattctctttgctgttatttcgatacagatacatacgctgattcaaaatccagatgtttccatatccgttcccctgaaatataacggttcttttgccatctgcatccgttcgcaccagctgattatcatcacatttcacataatagtaatttgcgtacaaagcagctgttttcaaactatctcttgtatactcccacgcataggtttcattttcataggtaggatgagcagtaccggaatcatcaaagcctgtcagtatttttctatgcatatgaaaggtttgcataccaactgcaccctccccgttataaatagagctgtattcttttggtacatatgtatatagctgttcacctatatgaagcagctgtttgtacatcaattcagatttagcagcttcccgtatcttctcatctgttacagaacgattgcttgtctgttttgaacaagcgctaacactagctgtaaacataatcattatcagaacgaatagatatttttttcctttgtttgcttggtatcgtgtcataccgtcatcttctttctgtcatattctgtcacaaacagcgttacagcctcatcagattcggaattatgcctgtgcttattcaggatcacgatctgataaggtattgacatataatttcctcctcacgactttactcacgactttactcacgactttattatacttctatatcaaagataatcaatcaaagaaattgaatatttatagaaaaagagcaaagctgaagaatcctactctatgctttcctctttatttactattagaattatttacatcacaacagctttgccagctcgccgatatgctcgataacaatatccggctttacatcacctgatgcgatatcttctggctttgtttcaccgcttaaaacaagaatactcgtaacctcgctgccctctgccaccttgatatccgtatacaggcgatctccgataatggcaatctgacttgggtcacatccggtttcctcaacgatgtaatccagtgtttttctgctcggtttcccgaaaaactcaggatatttccccgtacttgcttctatcagcttggccatactgccgcagtcaggaataaatgtatcatgctccatcggacagtttaaatctggattgattccgtaatacaaggcaccttcccgaataaaggtacatgccttagacagcttatcgtaggtcagcgttgtatcaaagccaagaattacgatatccggatgctcttcatccagtgtccagccatgttcttcaaactctttgcgtaatgcaggtgtccctaccacatacacacgctttccgtcatgatgcttctgtaaccagcgaagaataacatgcgttgataccatcatctgttttcgttcaatatgaattcccataccatgcagcttatcgatatacgtttccaaatctctggaggaattattcgtaaagaaatagtattctcttccactattcttcaccgtatttagaaaatcatgtgtgtatggaaatagctccttccccagatagatcgttccatccatatccagaatgaagacacgtattgtttccatcctcttctgaatcagttccttatctgtaatcatataactccccttatctctaattcttccgataataatctacaaataccgtactatagtcttccagcaacccaagatcccacaacagctgcaaaagtccgtaccgcactcgcacttcctttgccagtatcacactgtccttcgccattgcttcatcaatgtcaatctgttctggacagtagggtgcctctacagacttgagaatggcagacacttcttccggctgcggcagctcctgctcgatgactgctttaatatccggccacgtttcctcgattaaatcgattcgcttcaacgccttttcaatattattttttccggtttttttctccaatgccagaacaccagctgcagctccttcaaagcgatccttcaccagcgcttcccatgctgcactatcaaaattctttatacgctctctacatgccgcaaagtcaataccatcctgtgcaagcttcttccacatggcaagaactcccggtgttgccaatccgacctttgttccatggaataccggcttatgatgggcaaatagaaacttcatttcccagtaatgcgatatatgatgctcactgccggatgccggacgtgaattaccgacaaagcccatagccataccggtttcaatcaacgcctcagtgatcgccttcactgccgctttatcgcgtgtcagtacaccatccgcatgcgctacaacctcttggatcgatttataaaccatatcaactatcgtctgacagtaatactcatcattggtaatatgtgcaatcttccagtccacaagacagttatacttccctacaatatcaccaagacctgccttgatcatatccagcggtgcatttgccagtacctctaaatcagcgaaaatggcagtcggtacatgacagtcataggttgtctttagatcatcgataatcagcgctgcaccgacagaagcgaagccatccatactcggtgcggttgccgcaatcccatagtccagagagaccttataggaaatgaatttactcaaatcattcagagtaccggatccaatacctaaaatataatcatatttccgcttcatatttacaagaatacgaaatacggatgcttcatcaggtacaacatcagcatcaaggatgacatgatcactatcgatgccattcgcgttcaaatacgtctccagctcttccccataaacacggcaggtattttcatcctcaatcagatagactgttttatatgcatgctcctgaagatacttcaggatgtcctccttcgcatgttcacaaacacggacatgctccagacgggttgtatgcactttaccgcaatcacatgcaaattcatgattgagataatcattgatttcaaaagaagctacattcatcttcataaaagcaccttaatccatattcacgaaacagcgcattgcagactcgatatccttctgcatagcatcctgtcctgctttggcagcatcatgaaaatattttacaggatacgcagcattcacaccttctccgcctgccttatccatatacgtaaagtaattgatttttcgcacaccgttggcgatgacttttttgtagtcttcatggcttacaccactgcctccatgcataacaatcggaacaccggtagcctcagatagttcctttaccagtgcaaaatcaagcttcggctctgaaaaatattcaccatgtaccgtaccaaaggagcatgccaaacagtcaactcccgtcttttctacaaaatccttcgcctctgcagggtctgtataatttttgcggtcggttgcacggttttctgtgataccttcattgttcaatgtaatccctgccattttaccgatttcagcttctatggtaaccccatatttgcgagccatggcaacagcttcctttgtctgcctgatattttcctcatagcttagtgcagaaccgtcaaacatgacagaggtaaagcccattttcagtgattgttcaatataatccagatttacaccatgatccagatgcacaacgacaggtaccttagcacgctgtgccatcaggaccataacagggccgatggtatccagcttcatgacatcgttttcctcatgcgtctgtgcgaatgcaagtattaccggcatatccagcttctctgccgtttccagcacagccaggatattttcaaaattcacgatattgaaagcaccgatggcaatattcttttcattggcaagcttatatacatcatttagatttgctaacataaaatctctcctttatttttcagctttttctttaacaggctgtcgtctattacagtaattccgacagctttgaagaacagatattttaatgctgctggcactgtcattttgagaagcgcagcatgaccttataggtatccggacggcttgcacattccatcgcttcgacaacatcctcatagtcatagacagcttcaatcagtggcttcacatcaataatccctttggatatacagtcaatcgcctgtgcaaaggtctcgattgtcccattctgtgttccggtcacaacaatttcctgagagtgaagacgtccggcatccacaaggatcggctcattgggatgaatagagctgaacatattgcacagaccgctcttggcagtcatctgaaccgcctgcgctgcaacagcaggaatagcggttgtattctcaacaacattggcaccgcgtccatttgtcagcagcttaacctgttctaccggatcagatgccagtggatcaatagcgatatccgcaccgattttcaaaccgaacgcgcgtcgctttgcgtccgtttcacttaaaataacacgtgctccctgacgtttcgcacaaagcacatgcagcagtcccataacgccgccgccaatgacaacaacatcatctcccatgttgatatgagaacggttaatactgttgatcacacaggccagtggttccgcaaaggctgcctcatcatctgctgtttcctttgggtatacataaagatggcgtgcttttacagccgcaaattctgaaaagccatagaagccggaatatccgttgtcattgaaatatgcagtaccttttgtgaaattgctgcagatattttcatgatgatgtttacaatccggacagacgccgcagtcatcaatgatatagtttataaccttatcgcctatatgaaacagactgggatctacacctgcgcctattttttctataaccgcactatactcatgcccgccaattcgcggatatgaccatttacacccctgatagtctctgacatcatttacgcagataccggatgtcagaacacgcaccaatacttcatcctctttgatttccggtaccggtatgtctttgatatgataatttctaggtccttctaatacacaggctttcattatagtcctcctattttcctaattatgaatcgcaaatttatgcagggaaaatccctgtcacttcttctttaaaaagcagggaccagcaaacaagtactggtcccttttcttcatgatactatgctaagattccagttaatccgccgataataccgatgataacaatcagaatgataatcttgatggatgtccatcgcttcttcatcagccagtaaactaacatcgtgaatccaaatggcagtatgccaggcatgacagcatcaaacagctgtgtctgcacattgaatttagaccccgatgtgacaagctccagaccacaggaaacctttacatagttggcaatcaagccacccataaccatacatcccatgacctgtgctcccagcagcagcttgtcgagcagacccttttccagaaaatccatgatggcttcggagccctgctggtaaccgaagaagaagttagcgaaactgaagatatagctgatggcaagcatcagaatcagatatacgatagcgccccataccgtaccggtcagcgtgatatcgatacagattgccagaaggattggaatcaatacaccctgatagatcgtatcaccgattcctgccagaggtcccatcagggatgttttcaaggaagtgataaattcacctggaatcggttctcccagtgatttctgttcctccagtgcgattgccattcccagaatacaggaaccgaactcaatatgaacgttgaagaattccatttcacgctccatgacctctttccgctttgcggcaccatccggatcatctttatacaaatcatcaatcaccggtacaaaggtgtgaccacaggccatccccatcattcgttcgtagttgtagcagcactgtacccaggtttcccagttaaaggctgcgcggtataagtgtttcttcgggatgacgtgtcttgctttttgttctgccattttagaaatcctcctctagctcagcttcttcagcgatgttccccttgccgctgttttctctgtaacgaacctgtacgtaaaccaatgcgcataataaggacaatacaccaagaggcagcagtgcaagtccggaatatacagctacaacaaatccgatgaacaggaatacacggctttcccctttaaagatatattgcagtgtaatcgcaatacccaaggctggcatcagaccaccgatgatctggaaaattttcaaaggtgttccggcaagcattgtaatgaagccctgaatataggttgctccgaaatatgcagccagggagcaaggaacgatacagataactgcagccatgatctgcggcagcagtacgttggcaatccagattttattgtattgctctttttcaacaaatctgtctccgatgtgaacgaagatggagtcaaaggtcatacggcaataccataccagtgtacccagaagtccgataggaacagccagtgcaagagctgtatcggcatccagattaccggtgatggcaaaggcagcccccagtgttcctgccagcgccatgtccgcaggcatggaccctccggctgaaataaagcctaaataaacaaggttgatggatgctccaaccatagctcccgttaatgcgtccccaaggatgattcccgcaatccagccgcagaccagcggtctttgcaccgtccataacccgacaaacggcaggtttgcttcaccaatccaatacaggacccccaatagaatcgcttgtactattgacataaatttctctcctctctgttagtttttatgtccagcagaatctgtcttataacaggtttgatatatcgactaccttctgctcaggtactaactgataataaacatttacacccttctcatttttcattctgcgaatggaatccacttcatccggactcgctgaaacattattgatgaatggcttgcggtccccgcggattcccataccgccaagacatacctctttgatttccactccgccatccagcagctgttcaaatacgatcggtgtttttgtcagaacgataacacgttcatttcccggatcgggcttttggagtgccttcgttgcaccttcgacagacaatacggcaaccttggtaccctgcggcgccaaagccatcagtacccgtttgttgaatttatccgcagcaacggtatcatctacaatgacaattctgttcgcactcagactcggtgtccaggctgttacgacctccccgtggatcaaacgatcatccacacgtgctaaaacgatgtttcgcatttttcatcctcctcattatcaagcatgtcagctaagtatttttttacatcctgtacggtgctgcctgccagcttcatagcttcatcacaaatttccgcagcgctttttccatttcctctcatcagtaggatttccatcagcaggggaacattgattcctgttacatggtatacatcataggtgttcatcagctgtacgacagcattgaacggactgccatagaacaaatcggtcagcacaaggatttcttccccctcacctgcctttttaaattcattctcaatattttctttcaggatatccactccctgatgaggatacaggccaacatatgagagattctgctgttcacctaataccatttccattgtctcaaataatcccttggaaaaagaaccatgagatactaagataaccttcataataccctcctttctctatacatttttcactggtgaaagcactgctctggaagcggttccaccatctggttatattctatacgatttaccgcagcgttttttattttaatatgcgtaatcattacgtaaccggattttttatgaggttcgtattgattatgcaattttataatttttttattacaggtgagctcactcctgcatgatttgcttcagcgcagaatacatgcgcttgtatttttcatactgacgatggtatgcctggactgccccatactgtgctgtatatacctcaccctgctggtcgcaggacctttgcatcaaaacgccatctgccatagcagccagaagtgccgccccatagccgggtgttgcttttcccgtgacgacctccagctcggtgtgcagaatatcagccagaatctgcatccagatacgactctttgttccaccgccattgatctttatacgggaaggccattgtgctagcttcatattttcaagcgcttcacgaatcgcgtagcctacaccctcgaacacagcttgtgtcatatcctcccgtcgggaattggcgcttaaaccgataaaggcaccccttgtgctcagatcatgatagatgagcttatcccctgtgatatgcggaaaaaagagaatggtgttctttccgaaacgatccggtgaaataagcttttgatccactgccatatcatctgttttaattatattttccacccaccatttatgcgttcctccggctgcgcgcacggttccctgcaccacattgacgaactgtgtatgatcggcattgaacaggacattctttcctcttccttcaaaatccatatcctgcttcggcagaataacaacaccggaggttcccagcgaaatgattggctctctcctgtttactatccccattgccaccgcatttgcgggattatccccggttcctgcaattacacggatatcatgtgtcacctgcagacgttcacaaagtgactgctgcagtgtccctaccacatcacagctggcatacagcggtcccagaaagctttccgtgataccaagcttatgtagcatatacggtgaccatttctttgcggcgatatcatatagggagcttgtggaggcctcacagtaatccgcactgctcttccctgtcagtctatatacgatatatgcatacggtgtcatgatcttgtgaatgcgtgcaaagctacgcggttcatgctctttgacccagagtgtattcactgccggactgcccggtgataaaattttagcgatatatttcgtttcttcccgctgcaggcattccttacgaagcttttccaccatacaatctgttcttaggtctgtccacataatggcattgcgcacaggctctttgttttcatccagaaacacggtggtatgcatctgtccggtaaccccgattacagaaatatccttttggttaaaggtatcaactatatctgccaatccctgcataacagcctgcatccatacatctggatcaatctcccgccagtcctccttcggctgcaggatcgtatatccatagctgttttcatatatgatatccccattgtcatcaatcaccgttgttttcaatgcggatgtaccgatatcaagtcctatataatacacagaatccgtcccttcctatgattccttcaacccgttgataatttgaacaagatcagcggcagttgagctgacattctctactgccttggcactgagaccatacagattagcttcgttatggttcttttcataagcctcaccaaaggtctgaataaatgctttgcgtaaatccgatccgtaattcaccttgatcatgttgtagtccttcatgcgtttcacctgatcaaatgggataccggagccgccatgcagcaccagcggaacaggagatactgccgcaagcttttccagcagagcaaaatctatcttcgctaccgcatccagaccatgtacatttccgatggaaaccgccagaatgtcacaaccggagcgctccacaaattcttttaccagagacggatctgttttacagtctgcctcatttacatcatcatcctctttccccatgattgctcccagctctgcttccaccggaacattatagaagtgacagtattccactgttctctgcacctcttttatattttcttcaaaatcaagatgggaagcatctaccataatggaggtgaagcccgcattcacacaggcctttacatcatcaaagctttttccatgatccagatgcaaaccgatcggtgtatctgtcccctttaaaaattctctcatcatataggctatcacttccggatttgataaatgcagattatttgaagatatctgtaccatacccgggagatgaacagcatgtaagccctgtataattgcctttgtcatttccagattcgtcgtattgaatgccggcagcagaagatttttttcctttgcataagcaagcaggtcatatccatttacaattttcatcctcgttcctcccttattctgaaaaccttagcagcaccttaaatgtctccggacgcatagcatcctccagggcagccttaacatcggtatagtcatacaccttttcaatcagcggctttacatcaatgattcctttggctatgcagtcaaccgcctgtgcaaaggagcgcactgtcggactaactgtaccagtaacccggatttcctgagaatgcagacgccctgcatccacaagaatcggctcattggggtgaatggagctgaacatattaacaagaccactcttggcacacatagcgattgcctgtccggcaacagccggaatcgccgtggtattatatacaacatttgctccgcgtccgtttgtcagcagctttaccttctccacaggatctccctccataggatcaatcactgcatctgcccccagttcaagtgcaaatgttcgacgttcggcgcttgtttcactgacaatgacctttgccccctgccgcttcgcacaaagaacatgaagcaaccccataacaccaccgccgataatcaccacatcatcccccatgcgaatgccggttttattgatgctgttgatcacacaggcaagtggttcactaaaggcagccagctcatccggtgtatcctgcggaacgatatgcaaatgacgcgcctttaccgcaatgtactcggcaaacccaaagtatccggaaatacctccctcgttataaaaggttttccctttttccgcagcgtcacagatgttctcatgcgcatgcttacagttgtaacagactccgcattcatctataatgtaatttaccactttttgaccaatgtggaacattccggtatcaacaccgtttccaagcttctcgattacaccggcatactcatgtccgccaacacgcggatacgtatacttggagcctttgtaatcccgaacatcattcgtacaaattccagcgacagtaattctcaacaatacttcatcgtcttttggttcaggaatgggaagatcttcaatacgaacatctaagggtttctctaaaacacaagctttcatacttcctccttttacgtggtaggcttatcctttctgtaacaaaaagccttaccatacgtcttacaattccattataaataaattcaatggccgtagtttcggataattgcagagtaattatgaagtcatttcaggggtagtcttgcgtatcaattacgcaaaagacaatttttttcgtaattgataatacggtatgatgtacttgcttgcatagggtggggcctacttatttttgatttgttcgttttgaatacataaggaaaggagaagtgaaatcccgcagacagttttgggtttcatagtgaaaagaatgctaacaaaaagacaatccagtatttttttagagctttgcgaaaaagttggtgaatactataaagcgaactatttttcggataaatttaatattagtcttcggaccatccaaaatgacatcaaggcgatcaaagaggacactgcttctttatctgatatattcatcattgattccaaggtaccctttggtacaaggatcaaaattctggatagagaacgctttacacactatctcaatgatttgaagctgcaatcagatgaatacaacatcaattacagggatgatcgcatctataagctcctgaatttcttattaagccaaaggaaaagtatatccctgacaaaatgcgcagattatatctatgtatcaaaatccactctgaccagtgatttaaaggagctggaaaagaccctgtcgaaattttctttacgtttgattcagacaaagggatatatatggattgacggactggaacgggataaacgcatctgtctgatggatgtcagctatgcatatcaccccatgattcccagtaagctgatttctgatacagaagctgttcatgttgaatttatacgaaagacgctgatgaaggagctgctggaaaagcagtatccgatatccgatgttgaatttcagaatatcattatctggctaaatatctccatccgaagaatcaccaatttcttttatctgaatgacgaggatattgacggtgagggaaactatgacacggaaatcaaaattgcaggaaatatatttgagcgtattgaaacaaaatatctgatccgtgtaccgcagacagaaatcaatttccttgccatgtatattaacaaccacagtaacttcagcaatactgattatatatcagaggatctgaatacatttattctgcatgcgctgcagaaaatacacgaatcctatccaacggatttcacacacgatgtaaacctgcgaatatcactggctctgcattgtgttccgctgatatccagagcacgcaataatgtacagatcaaaaatgaaatgctggattatatcaagcagagctttccgtatgcatttgatattgccacatatttctcctatctgttatccgagcggtatacatgtaaaattaaagaaagtgaaactgcctttcttgcaatttattttaataaaagcatcaatgagtattctgttttaaagggcaacaaacgagtatgtatcatcacaaatctaaaacgctccgagtattttcttctggaacagtttctgtatgataaatttcaaaaatatatcgtatccataacctttgtttcctccaatgaactggatgatttggatctggatgcatatgatttgtttttttctaccgaggataacagggctacggaatccggcttagcgacaaagattgcattttttccggattccaatgagctggagaaaatcaaggtgcggatcgaaggctttaaaaacgttgaggacattatgaagctgtttgatccaaagctgtttttcgtaaaggatttcacagaaaaggaagagattcaaaagtgtctggttgatgctgcctctgtgctgtatcaattagataatctcgctgaggaaatcgagctgcgtgaggaattcggctccacctattttggcaatggaattgcaattcttcacccgatgcatctgcttacagacgattcatttatcggggagatcattctcaaaaagccggcagtctgggatacggagggaaaccatgtcaatctgattttcctcgtatgcattcagaaaaacaatttagaggcctttcgtgcctgggattatctttcccctctgctgttcaataatgaattcaagcaggaaatactgtccgttgaggattacggagatttcaaacggatatgtgaagagaatctgaaatcgcatatattgtaggaggaacatcatatgacatttacattcctgattaccgctgctgttcttattatcctgttgatcattccacagatcatgaaacgagttgtatacaaaaaactgacaggttatctgtcagaaagagattatgagcaatttgaaaagctgctggacgggtttgcctgcaccttttccttcaagccatacaatcgggaatacatgcggttaaattcctatttcatgcaaggtgataaaaggaaaatcgaggcacagctggatacgattttcagtaagatgaaaatgaaggatgagcaaaaggcagcggctgccaggcagggattttacttctatatggaaaatcagaggtataagaaagcagaaagcatgctgcatatctgtcgaaaagctgataaacatattcctgagctgcatacgatggaaatgatgtacagtattcttgctctgaaaaagagtgagtatatacaggaaatcagagagcggctggagccgatgaagaaaatgccggatgcttttaccaatgatgcaaagcgtgttcgtattggtatctttgaatatttgcttggtctgcagtatacgtatctctgcaataaaaaattaagtaaaacctatctgagctctgcactgaaaaattgtagaaatacgccttatgaggttgaaatccagaagctgttgaaggcgtgataccatgaagctatccaccacagaatacagtttcaatgcctctttgtcctgtatcgatctgggacatgtcgcagacagtatgaaggaaatcaatcagtcgcgtataaaaagtcttcactatgatattgtggacggtcagtttaatgaatgctttatatttggtgatctgatgctgaaggtatttcgcagctatacgacactgccaatcactgtgcatctcgcctgccgaaacccgcttccatatataaagccctgtatagcgaatggtgctgattatatcgccattcattacgaggcggaaacagacatcgaagcggcctttcaacaaatacgcagacttggagcaaagccggtacttgcttttcgctgtgacacgcaggtaccaaaggattttattaaactggcagcacattctgaatggattcttaaactgagtgtacagcctggcttttccgggcagcttttttagaaggaagcacttcagcacatagtacagatgaagcagctgcttatggaggcaaagctggataaggtgatagaggctgatggaaatattcatacgggaacgatacacagctgtgcaaaggcaggtgcaacgatgttcacaggaggaacctccggtttatttcaccaaaagtacagcattgatgaaagcattgcgcttcttgaacaggccatcgcttcaggaggaatttcaaatggcattgacaatgaatgaggaaagtaaacaaaaggaactgaaaaagctgctttgcgagaacgagaaatatctggcttccacatggggaaatatcgtatcctctacaccgaagctgttatcctatgccgttgccgcagacagacgtccgaaaattggttccagtaatatatactgctatgtcggtttgacaaaagcaagtctgaatatcgtcacattgcattctctggatgtgacaagagcaaccggatattttcgtataccattgcaggatattcagaatgcagcagtgaaaaagggtgtattaaaaagcagtgtgattctgagctttgaaaatgaaaggtttaaaatattatggtttaatgaggcaactggcacggatatgaagatgcagagaatcagtgtacgaagaatctgtgattatttcattcatgtatcagaacagtaaaaaccggcagtgctaccatagattcttacgcacattggatacaagtagttgaaaagctaaaagaagaaataaaatcctatcacaggagcttttatttcttctttcattttttacttgactctacgatttccataatcgaagaaaaccttcaataagcttccgtttaatcttccctgtgcatcgtttccaagtcggatacctttctttcgtgcgtatcatattttagaaaaggtctgaaagcgtcgaagaaggccatatagcaaaaggctgtttcataagcatagttacttatgaaacagctgtttgccttcatcctgaaaaagaagtcagagatgttaagatatatggttcgtgaactaccaccggctatagagcaagcggcttctaatgattgcttgcgcattcataaaatctctattcatttcgcttgtcaatagatgatatgctccagtattcccttcatatatgcaatggcaattccgtaattcgtcatcggtattccttcctgttttgcctgctcgactctggacaggacatatttcttattgaacatacaggcaccacagtggatgatcaaatcatactcctgtaaattctttggaaaatctgtaccactcacaatatccacctgcaggctgtctccatatttcttcttcagcatggccggaatcttcacacgcccgatatcttctgcaagaggagcatgtgtacaggcctccgcaataagtactttgctgtccgcatgcagctgattaatagcctttgcactctggatgaaatattgaatgtcccccttgtaatttgcgaataacacagagaacgaggttagtagactctcctctggttttttttcatatacaagaggaaacacctgtgaatccgtaataatcagctttggcggctttgccagtgctgaaagagcagcctccagtgtatcgcttgtacagctttgaacaatacatttatgatccagtaaatctcgaatcgtctgtacctgtggcagaatcagtctgcctttgggagcctgtatatcctgtggcataacgagtaatacaagatcatttgctgtaaccagatgtccggttatggtttcttccgtaaattcagagggaagcagtcgaatcagagcctgtcgaacaggctctgctgccatatcctcagccgcattcacaatgagtatctccccacctgtttttctttccaatttccgtatcgtatccattgcatgatccctgtcagctgtagctgcattccatatacagagaacaggaatctgtttctctttcaattttgcataccatttcatttcccaggaaatatctaattcccgaaacacgagaatagcgatatctgttttctgcaatacctcttctgttttttcaacacgcagttggccaagctccccctcatcatcaaagccagccgtatcatagaacaccaccggtcctattccatgaagctccatcgcctttattacaggatctgtggtagtccccgcaacaggagaaacggtagaaaccttctgcttcgtaatagcatttaacagagtggactttccgctgtttcgttttccaaatattccaatatgcagacgcactgcattgggtgtatcctgcatactcatatcaaaaccggaaatcccgtttcccctcatcgatggagtgtagataggaggtacaggtttctcttgccttttcatttggaatatttaacagctcctgttctattctggcactgcctagctttttggtatcctcttttgcataatcatcaagatactcccgcagtgtcaataatgcatttggatgacagcagtttgcaatctgcccggattttaccagactcataaagcggtcccctgttctaccttcccgatagcaggccgtacagaagcttggaatatagcccagcttcagcagccagttaaccacctcatcgagagtacgattatcacttacatcgaactgtgcactgttttcctcttccttttccggtactgcatagccgccgacactggtggaagaagcaccggatatctgtgaaataccgaggtcaagaaccttttctcttgttttctgtgattctctagtagagataatcataccggtgtatggtaccgcaatccgtaatacagcaacgatcttggtaaagatctcatcactgatcgcatttgtaaattcatccggattgatatcatcggcaggacagatacgcggaacacttatggtatgaggtcctacgccatgcactgcctccagatgctcagcatgcatcaaaagtcctacaaaatcatagcgatacatatttaagccgaacaatacaccgcagcctacatcatcaataccgccctccatggcacgatccattgcctccgtgtgataggcataatttgattttggaccattgggatgcagctgttcatacgattccttatgataggtttcctgaaacaggatataggtaccgataccggcatcctttaatttcttataattttcaacggttgttgccgcgatatttacatttactcggcgtattgctccatttttatgcttgataccgtaaatcgttttaatgctttccaaaacatagtcgatcggtgaatgaacaggatcctctcctgtttccagagcaaggcgcttatgtcccatatcctgcagagcaatgacctcctgccgaatttcttcctgcgtcagcttttttctgcgaatatgcttgttcttatgatgatagggacagtatacacagccgtttacacaataattggagagatacagcggagcaaacatgacgattcgattgccatacagcttctgcttgatctgctttgccagcgtaaacattttttcgttttcctccggcagctcacattccagtaatacagcagcctccctgtgtgtaagccccttacaatcttttgcacgttcaatcagggagctgatcaattccttattacgcttgttctcctgtgcaaagcgcagcgtttctttgatttcctcatcgtcgataaattccgacgctttcagtgaatgtttattgtacatatacgtttttcctctatctttcttatactgtcgccgcgatctattaccagttcatatcctatgcgtttcatacgattggacagacataatctgcattcggctgcttcatcacctgtgcagattttattatcatacagcatatatttttttctcacagccaccggacttagattcggcatgacaacattggcacctgccagaattccctgttctcttccctgtggatcaatcgtgcccagagctgtagttgccggaagcagaacatccggcagtatcaggcgaatgatggaaagcaatgtcagtgtcagcgtgaagctgccggcctgctcattacgaaacggtgtatcatgatgcggaagaaaaggtccgatacccaccatttccggctgcagttccttcatgaaatgcaagtcctccacaatattctttagcgtctgtgatggagaaccgaccataattccacagccggtttgaaaaccgattgccttcaaatccttcaagcactgcttgcgatgctcactggaaagctcttgcggatgcagacatcggtaatgctgtgcattgcttgtttcatgtcgcagcaggtagcgatcagctcccgcatcaaagtagcgctgatagctctccttttctttttccccaagtgacagtgtaatggcacagtctggatactgctgttttatatcggttatgatttcaatgagtttctcatccgtataatacccgtcctctccggactgcaggacaaaggtgcgaaagcccaatccatagccttccttacagcaggcaagtatgtcttccttttccagacggtatctttgcgcacgggtattgctgcggcggataccgcagtaataacagtcattgcggcagtaattgctaaattctatcagtccgcgggtatagaccttatttccataatatctttgcgctgtttttcttgcatacgcagcaagctgactacgtaagaaagcatcctcgtgatgagcaagcagctctagaaattcttcatcccgcagccaaccactcttatacagcttttccatcagaaattcgtaatcagccatccgttttctccatcacattggaatacagtgcctttgtactgacaccctccagctttccaagctttccggataaagcagaaatcacaggctgtggcgcgtccataatgatactgattaccgaaatttttcttttttgatacggtactcccatacgtccgagaatatattgtgcatattcatgaagtatggaattgattttctctgcagattccgtattttctacaatgatgccgataacagctactcttgtttccatatgatcctcctaacataaaaaaattcttgtccgaaaaaacaagaatacagtaaaaaaactatttgcattcccgtctttttcctcaggctgttcctttagaagcagatcgtcagcgatcgatgtttgatgtttacagtcagatttactttccgctcacttcaacaccttgattatagcaccttgtttatttgttcacaagcaatatggtgcggctattaaaaaaaatgtaaccctttatttataaaattatgtataggatacaaagcatctgtcaatcctcagcctttcacaattgattcataagaaaaatacaccgttattatgttcatttgtttctatatatgttttcatatgttttccttcatatatgctgtaaaagaatttcaataaattcataataggattttgcttttagtaattcttccagctgcatatcttccatcaatacagatgatagaaattcatataattcaataaacagctttttatcctgatcattaatagcgatgagtataatcaaatgtaccttacggcttccccaaagtaccggctccttattcaagacaatattcatacaggtttgtattgcattcatttttgtcgcatgcgggatagcaacagaatgaaatgaggtactggataaattttctctttcctggacatcatgttcaaaaaattctttcaccattccagcttcatacagctgctttgacattacatgaattgcctcctccctgctttgaaagcttgcatttttcttaaatagagacggctttgtatattccattaggatggattgaaatttctgtttctttttctcaatcaacagacgatccatcagcagctgcacctttctttggtctgccttattgaaaaacggtgtaatgataacctttggcatatccagttttctatcaatcgaaaccgtagttaaaataaaatcagctgtattcgtgatatcttcttcgttggtaataatattttttatgtcagcatccttacgaaaaacagatacaattcgatcagataaggaaatatcaagatcataatattgtggaaataacagaataaaagatagcttatgcttctcgttattatgattttcatagacacttccaatatgaaatgccagatatgctatttcatcgtcattgataatataacctgtttctcttttaataatgtgagaaatattcacagcataatcataaatcagcggacatttgttccgtatattttcagtaagtggattctgcgtaaaaaaactgttttgacaacgaataagaagtccattcatatgaagtgtaaatcgataaataaaatccttatcggacagatccagaaaatagttttcactcatttcacagataatgcgttctgttatatccgagcattctttggtaacaagattttttaattcatgatctctgaagtttgtattgatggcacttccgataaccagcaatgttaactcatataattcgctgtcattaaaatgcaattcataatgctcttctagggatgctataatctcttctgtcaacttgaattcatgctgcttaatttgaaataatttttcaggcttctccatgtattcatattcatgatcgattctatccattgcaatgataatatacaaaattaagtttatcatggagtaatcattgatataaaaatgatatttccggaatatctctttcaaaacatattggataaattctacattatactgcgggtatgatttctgaataaatcccatattcatgaatttatcactggattcctcatacagaagtgtacgaaccatctttcttttattcttttcgagcccttccaaatagatatcatccccacactgtaccagcttcaaatcgcattcatacaattttttaccgactcttttcaaatcaagctttaatgtggactcactgatatagagctcatctgcaaggtcatgaatgttaattttttcctgattgaaatcaatcagctgttttatgatatactttgttcgttcatagggtgtttgcggtaactgttccttgaataagacttcaacctcgatatcctccctgagcttatatcccaggttggaagataaaataatctgtctgcctgtatccatatttatatccgcaacatatttacgtaatgtgcgaatggagcagtcaagctcagcagctagcttttttgaagacttccaaaatgtggtatcaagaaatttcaacaaatatcgctgattctccgtcatagtatcctcctaccccaccgcataccatattctccgccatatatactatcctataaaatatataaaaatgcaatcattaaaatgcacagcaggtgtgcattttcttatttgagcctactgaatttacagcttataatgcaatcgtcaaagaaacggaggattttatatgaacaaacgagtatttccagaaacatttttctggggaggtgctatctctgccaatcagtgtgaaggcgcctggaaggaaggaggtaagggttggtgtattgcagatatcaataaatttgaaccacataaggatatcaaaaagaaattcaatggtgaaatcacaactgatgatatccgtgtagcaatgcaggatacagacggtctgtatccgaagcggagaggcatcgatttctatcatacctacccgcaggacttaaagctgcttgcagaaaccggtatgaattctttccgcatatccattaactggtcaagaatctatccaaatggtgatgatgcagaaccgaatgaggaaggactgcgttattatgatcagctgattgatgaaatcaaatcaaatggaatggagccgcttgttacactttcccattatgaaatgccgctcaatttaacattaagctgtaccggctggtacagcagagaaacgattgatttctttacacgatattgtgaaacatgctttaaacgatttaaaaataaagtcacatactggattttggtaaaccagatcaacttaatttcactggaatccttcaatcaccttggtattgcagcggataaggtttcaaatttaaaggaggcgaaatatcagggacttcataatgaactcgtggcctgtggcagagctacagctgtagcaaaaaaaataaatccgaattttcagataggtgtgatggtatgtgatgaaatatcacatcctgcatcctgtcgtcctgaggatatctttgctacggtgaaacgaaatcaaatggaatattatgtcacagatattgcactgaggggtgcctatccgacatatgccttagctttttaccaggagaagggctatcatataagcatgcaggaaagtgacttttccgatataaagcatacagcggactttcttgctatatcttattactatacacggatttccgattataacagtgtatttcatccaaaaacagaaacagcaagtgtaagtgaaacaaacggtgcttatccaaatccatatttaaaagcaaatgactggggatgggccattgatccgcttggtttgcgaacctctttgaatatctactgggaccggtaccagaaacctatctgtgttgcagagaatggatttggtgcctatgatacactggaagatgatggcagtatccacgatgcttaccggattgaatatttgaaagcacatgcttcatcaattaagcaggcgctgcttgacggtgtgcagtgctttggatattacccatggggtccaattgacattataagctgctcctccagtgaaatgagcaagcgctacggctttatttatgttgatctggatgattatggtaatggtagtggtaaacgattgaaaaaagacagcttttactggtatcagcatgttatacagacaaaaggagaggatttataatgaaaaagcttaccattatgctatgctgtggtgcaggtatgtccagcgggtttctggcacagaagacccgacaggctgcgaaaaaacagggaattgaagtaagggtggacgcaagaagtgaaagtgctgtggagcaatatgcggaagatatagatgttcttctaataggaccacattgcgcatcatcatttaaaagtctgtctgaagtatgcagggaaaatcagatttccatcgcaatgataccctctgatatttattccaatctggacggcgccggaatccttgcactggcatttgaaatttacaggaaggagcataccttatgaaaaaaattatgttatggattacagataaatttgcaccaaaaatgaataaggtggtggaaaatccatgggttgctgctgtagccggatccatgatgaaggggctgccctttattcttgcaggctccctgatttccttctacaatgtatttcgttcctatgtttcagcgcttccggacttgggtaaggttgcggatttcagctttggatttatcagtatttttctcgcctttcttgtcgcaaaccagtgtatggaaaaaaagaagctcagtcgttataccattgttgccggattgatttcaatcgctgtatttgtcatgttctctatgccagagttcaatgagcagggagaaatcattcttacgtttaaccgtatgggggcaaccggtatgcttgtagctatgctagtcggcttatttacaggatgtatattcaatttatactctaaattacatatacttgaaaataacgtaactattcctgattttgtaacggaatggattaataatctgattcctatcctatgtattctattgatttccaccaccattgtttttaccattcaatttgatatctttgatttcatcttatccttattctcaccgttgcagaattttggacaaacactgcccggctttgttctcatctgtcttatccctgctgtattgtatacattaggtgtttccaactggctgttctatgccgccagtctacctatctttatggccggtattcagggaaatattgaagcggttgccgctggaaaagaggctgtgaatattgttacatctgaaactgtatttacagctgctttgattactatgggtggtatgggagctacacttccgttaaatgtcatgatgatgttttcaaaagcaaaaaaattaaaggtcatgggaagaatctgtattggtccatctatctttaatataaatgaacctcttgtatttggtgcacctatcgcctttaatccgatcatgatggtgcctttctggctcacctcaattgcaggacctgttatcatctggttctctatgcgcctggatctgttaaatattccttaccgtatgatacagattgggcagattcccgcaccattttccagtgttatgataacggaggatatgcgagctgtgattgtgtatatcattttatttgcagtatattatataatctggttaccgtttttcaaagtctatgaggttcaatgcctaaatgaaggagaataacgtggatacagaaattacacaggtagccatgcagattatcctgcatgctggtgatgcacgaacacagcttgaaaaagcactgggtgaagcggaagatggaaattttcataaggtggatcagctgatggaggaggcaagagataatatcatccttgcacataattcacaaactgcacttatacaagaagaagcccgtggtaatcatcatgaattcagtatgctgttcacacacgctcaggataccatgatgacaattcagtgtgaattaagaataacacagcatattataaaaatattacgacgtctttaatagaaaaaagccatatgattgtgaagcctatggctttttttctgaaatctcttaatcttatttatattccaacacaataatatcgtgagagccttatgaatgctgtgatgttaagctcttttcatcatttctgccataagcttttctccttgtataacacaaattgtgatatacaaattgtccttgtttataggtatctgacacaatactctattataatatggaggttcgttatgaaaatagaggcaaacccccgaaatattagctgtacacctcttatggagttacgattcacagccaattcataaatatgtgatttacgtatgaactattagaatatggggctaatgtagcaggtcctatattttcatttattctcatatgctgatccttctctatgtttcaaagggctgtgaatcgtaaccttatggatgatgtttctttttttgcatcgcctgtattatcctctcataatgaatgattttttgatcatcgggtataggaaaaagcgcaggctgtgataatcctatggttttatatttttctctgccaaatgtatgatagggaacaatacgaatttcttccagtgtgtgaagctgtgcggcaagttgggcaatcgcctctagttcctttaaatcatcattgattgtaggaatgagaggaatacggataaaaatttttttcccgcaggaatccagtcgatgcagattatctaaaattttatgatttgaaaaacctgtagctttcctgtgtatctcttcggatgccgcctttacatcatataaaacataatccacaaacggaagaacagcttcaaaagccttccaatctacattgccggcagtgtctatagcgattgtatttacgcccttctttctacacaaatcagccgtttttgcgacaaatgaggcctgaagaaggggctctccaccagaaaatgtgatacctccgttttgctggtagtacggcatatcccttaagccaatctgagccagctcctctgcagtatattctttcccgcttttttgtaatgcatttgatggacaagaattgatacattcttcgcataaactacattgattgaaatgaacgatatgttcactttcatgaaaaacatgcacattctttgggcataccttttcacagattctacattgaatgcactgtgattcatcatactgtaatctgaccctactctgtaatccttccggattatgacaccattgacaacgcagtgaacagcctgtaagaaaaaatgttgtacggatacctggtccgtcatgcagcgaaaagcgctgaatattgaaaacggtacccatcagttcacagcagtaatgcggttgattacatggtcctgcatttccttgcataaggtgacaaagcgggcgctgtatccccatacacgtacaatgatatctttgtgctgctcaggatttcgctgtgcctctcttaacagttcagcatcatatattcctatattcatatggtttaatccacccgcaactgctgccctgtttaatccgtccagaatcatcagactttcttcatccgtattgccaagattacgaggaagcgtaatctgtactgcacatactccaaccgccatactgatttcttcctttgcttttgctatggaattaagtaaagccgtaggaccatttacagctcttccaggtgttgcgcaataatgctcagcaattggatcaccataatgtcttccatcaggagttgctgctacaccataggattcctccagaaaacggaatccatacaatgccggcataacagcaaatccactctctttccgaaagttttgcaggcagtcacaaaagcagcgagcgatatctcgagcaagtaaatctacttcatcgatatcgttaccgaatttaggagtgttcagcatttgttttcgcattccctcataacccttaaaatctacacgaatggcctcctttagttccgaaatcgtatatatttttctgtcatacacaagtgatttaacagctattaagcaatcggctgctgttggaatagagcctgaaaatagcatatattctgcgaaaggaaaaccgcctcccagaatatcatccccatgttccagcacaaaatcataggttccattcaaaaatacagaagtggtcacaaaactcattcggtcatcgtaaaggcgcttcaattcctcagctttatttctaatctgaaattcatactgcttcaaaaacatctgatagaatttttcaaaggtctcacaagtctgcggatcgcccgatgcatatccacagactgcatgaggtgtataaaaataatccggatcactgttattccaataatgaacctttttacggtaagtacggtctgcccagcttccattgttaaaagccaattcaaatactccgacaatatctatatgagcataatcaataccactatatccatctaaagttatttcagaacagccgtcattggcataacagcaggcaagctcttccgggatgccaaacttcataagggatggaattatgacttcatcattatacatagtcgcctgtccctgccccatgagctgtacctccagcatggcctgataaatagcaggatccaattccggatgtacacgcacattgatatgcggctccgtctgcctgcaaagctgtactgctttcagcatgagaacagatagcctgctgccggcatcacttccatctatatttctgccacctaccataacattaagcaatgtatccccgctgtcattttcattcaagagctcccaaaaacaaagcagatagtcaagcacatcctgctcgctcatatagccggaagtcatatccttttcaaacaactctcgcagatgaacatccagtcttcccaagtcagcatgctttttatacaatgtacgaagcttccacatgatatacacaagctgaagtgcttcatcaaaatgctgtggaggtcgtgtcgacaaagccttcagcatgtcccctgtatgccgctgtttatctgattcagcttgcttatgaacagcttctgcctagcgtgataaataattgctgatttccctatatacgattgctatggatgataataattcacgctgcttttcggtttccacagtttttgatgattcttcagctttttcagataccccaagaataccaagcttaagataggctgttcccatggcgtaatgataattatcgttcataaacatttcctgctgaggtgctctgtactcttttacaattcccgctaaaagtctgctttcaggaaacggtacaggcagctggcaaagtatttctaccgtattttttacgattgcttcatacatgaaatcccttctctcatcgtttttctactatacgcatatctataatgcatacatcaaatcgctgtgatctcctcttttctacttttgtaatcccaatacaacaggaacggatttatacccgattcccattcgttctacccccatgtcaatcagcttcagaaaatgctctctggtacgtatacagccgcttcctttaactttgatttgatctcccacctcatccagcatgatttgtataatttcaggtgttcctccgacacattcatgtccggttaaaaagcctgtgcttgttttaacaaaatcagcacctgcagctgcaacgctatgacaggcttttcggatctgcgcttcagtcaatgcatctgtttccaatatgaccttcaatccataacctgcggcatgaactatttcggctactgcccgaatatcttgttcaacagcttcgtacttctcagaacggatccatccataattggcgaccatatccatttcactgatatgtggatatctgcataatatttttgcctgttccaccttacattcggtagagcttgtaccaaagggaaagtctaaaacaggggatagcttggtatctgtaccctcaacataaggaagacataaatccatgtaggccggattgatacatagattaaaacagcctaatttaacacagtcctttgtcaatttgatgatttcttcttctgtaaattccggtttcaatacactgtaatcaataaatcttgccaattctctctgactcatttcagcagctttctttttcaatttcatatgacatcacctcttatgatttaattctatcaatatctatcacagttgtaaatgaatattgatagtttttgattattagacaatatttttgtaactactcattggtatgaaaatcgatatatgcccataagaaagtttcataaaaatatcaaatgaaagggtatttataaactacgaaagaacgtactatacatataaatgatattacatcatatgctatcagcactgttaattggtgaacagtaacctgactcttctaacaaaaaatggcagtaaagggttcacttgtaaagggaataacagtataaatcctactccctcatagcatgaacgcagctgaaaaagatacttttcaaacatgttgaaaaaaatattggaaaaactaaagatatgttaattatcccttcattaaaatgtgaaaaaggtcccgttatcattagcggatttcaatttcaaataattcacagatagagtaaagtttctttattcttttaatcgctgcctgtgacttaatttaagattttgggattctccataaggttgagcatagtagttcagacaattcagtggaacttcaataatagtaaggaaaagtgcaaagctatgattacatgtatttaataatctgtaaatacaaatctttattgcgattactatcacagttaaaatttcgcaaattatgatttcttaaagttatcaaacatgataaaaagcggaaggttagtccatccacatttttacttatttatatccggacattcataaatctgcggcaatcatccagaaaattattctctcttctttttacatgctgaataaggaaaatcatatcactagaaatatataccctctatgtattatatttcatactgatttgaaatctctgtataactattttaaaccagctatatcaaatgaagcatcactgattttctctgctgttatatctaacagatatctatgagatttaaaattatcctacttatctattccttatccgctatgattaaagctgcatcagtattcagagcatcgctgatttcctccgtaataagaccgttgaagctgtcaagattggcaaaactataaaacccgtaaatattcaatttactggagtccattaccagatagacctcctgtgatttttttatcgcttcttcctttatctgtgctgtacctacttcagaagtaaatacatttaaattttctacactcattcctgcacagccaataaacgctttatcaaaattgaaagaatgcagtcccttgatagcgagtgggccgagattcatcttataaaacgtgctgttctctccaccaatgacaaatatagaaagtgtagaatcatcttttgctctgattaaatcactgtgtgttacaatcgttacgttcttcccttccagatattcacacatatacataaaggtagtcccgccatcaataaatatacaatcattttcttccaccagctcagcactttttcggcacaatcggcgtttgatttccggcaccatatccatacggttatccatatgaatatctgtgctttcataaagacggttattgaatttaacgcgaaccgccccaccatgcactctccggcatttgttttctttttccaatttttcaaaatctctgcgtatggtacatatggaagcatgcaactcttcacttaactgctttagatatacgacacccgatttctccaatttcttcaatattattatttgacgttcactagcaagcatatttttcaccctgtttctgttttatttcatataagaaaactgcaattagaatcaatctcctttgattagtattaacagtataccatatgatttttaagtttaacactttttctatgagacgattcttatattatctgatttccatgctactgtttacttcaaattttcatatatagtaaaatctttatatctgcgccagcaaaaagaattgcgttccggtctttaaaacaataccgaaatacaattcttatcgtttattcaatcgcaatcagataggtcgcaaatgcataggagagattacggagcagcgataaatcatcttcattccattcatgtactcttcgatcattcataccaagtacaccaatcattttatgatcatacaaaatctgatgctgcatggtagcctgaatgtgataatattcatattcatttacatactgaatttcgttaacattgatctgattctgataatagagatgtctgtcatcaaagaccttcagataaattggatctgtctgtatgtgaacatgcttggatgccttcttcttttccaaatcatatatatacactctgcccatagtatatgcttcattttcaaagcgaagcagaaatatgttttttacattcatagaacgacagatgaattccattgtctgctccagtagctcgtcccgtttatcaaacacattcagcatttcaaatacctttggcagaatgtcattgacggtgacctcgtggcggtccttgcgcttttcctttttctgcataatctgactgaaataatcatttttatagactacaaactgatcacgtccgtttgctttcgcttcatacagtgcatgatctgctttcataaagatatcttcaaaatccttttctgtatctacgacacagattcccatactgactgtcagctgtttctgcagcttgctgatatttaaattgcgtatattgtcaataatacgcaaagcatttttttctatatcctcaatgcgggaaatatgattcaggtacatacagaattcatcaccaccaattctgccaacgagatcatcctctctcaaattattttgaagattggcagcaacctgcacgatcacctgatcaccaaccagatgaccgcaggtatcattgataattttgaaattatcaatatccaaaataaagaaggcccccttttcctctggacgcttttcgcggattgcatccagcacatggttacgaaaggctgttttgttcaatacctcggtaaagggatccagcttgttgctgcgaaggagctcttcattgcgctgcaggataatatgctgttcataaagtgcattttccaaatccattttattcatcatgctttgcagattattgcgcttctcctgttctctggcttttctgttcaaacgataggcctccagcagatggagaaataattcttcctttgaacaaaattgcattgccagctccaccttgatatccgcaagccttgcagagttaatagagcttggatgctgtgattccattttttcaagattgcgaaacagcagataagcctgatcctttagttttaatgatatgcagatttgaatacaatccatataatttctcactgtattcttataatcagaggtatgggaagctacctccagaaaatcatatagctgctgcttaattttttctatatccttcctgtgccataattcaaatatacgtatcataattttattctctgtcagtacgacatgatcatcatctttgaaatagcgcaaaaaggtttcataccagggtgctgcctctgccgcccgattcattttcatatataccatcaaaatattcgtcaggatgataccgtcatgcagcgaaaattccagatgcagctttctacgttcctgaaatgcccggataaagtattcaatccccttttcttcacaatctatctcatgaaataaagttcccagattgttgataatcgcataatgatattcaaactccggatgatccattgttaggtaataggctttgagaagaaaatgcagggaggtgagaaaatctcccagatcagaataaacgattccctgaaggttgtgtatgtaagcaagaattttcagatagtcattcttttcacagtattcctcactctgaaagcagtgctgaaggcattccttataattcccttttgaaaactcatagtatgcctgaaaatacaatgctgctgcagtgtagtaggaatcctgatgaagctgcgcaatttccagtaatcgggaagcccttttaagaatatcctccggtcttccctgcttgcgcaatgtaagaagctgttctacaagatcagcagcctcttttttatatacttccatactcatcctcttttcttttaataaaataacacgtattcgacaaatttcgcatatggaaagggagccatgctgtcttgcatgactccctgattttatgcattatcttcgctgtaaacgattttcagacgtcgctgattaccttccccttcactaacagtagcaatatgcttcatattggctaagtagttgtgaatagcctttctttcatcggccggcataggatccagtgttgcatcagtttttgtccgttgtacgcttttcgcaacccgaagagccaatgaacatactttctgatatttctcttccttatatccgttgatatcaatcagtacaccgatccggcgcttaaattcactggaagaagcagacttcaggacggtattgattgcctgtaatgtctgtccgttctttccaatcagaatcgcgttgttctcagcatccagattaacacggaaatattcaccgtcatccactacatcaatggagacctccatatgaataccttggaaataggtctgcagatatgctttcatgaattcccgaatatcatttctacagtaagccgtaatggttgttttgctgccaagtcccagaaaacctgaggtttcctccgttacattataagtgagctcttcaacacttactcccttatcctcagcagcctgcttcaatacatcttccagatttttgccagtatacgatttcatcctgttatcctcctaatctttgataaagaatttgtggattacaatattttggataactctagcaagagagtttaccagccagtagaaggacatacccagcggccagttgattgcgaagatggcaatcataccggtactcatgtacatcatcatgttcatggagcccatcataccatttccgccctttttcttaggctctgcatattttttctctttgacatgcatttttttctttctgtgttcctgcagccactgcggcattttgaaggacaacagctggaaggctaccatcagaacaaagatgacaatataccagtaatcacctaagttaaagccttcgatcggcgtcttagccaggttgattccctggaaggaaccggtaaccacgctgtacgcacgcatcgtcgcctgatacatacccagaattaccgggaactgtataaacgttaccagcagtgttccaaacggattgattttgtatttgctgtagagcgcctgcatttcctgcgcctgctgcatcttggagcggtcatcggttttacctgcatatttcgcctgaatcttattcatttccggctgaattgcctgcatacgctgtgatgctacctgtgatttgattgagaacaggaagatcagcagctgaatcaggaaggttgccgcaatgataccgatacctgcatcactgaaatctgctacaaagttgatcaggaaagcaatcggccatacgatcagcccattgaaccatccttcatccattgcatcagagaacgttgttttttcgattgtaatcagatcatctgccttataatccttatacttcttttgaagttctttatcgtctggaatgtcaacttctccgcgcttcacctgaacgtcatggttcgtgtaaatggaattgacatatgtcttaccattctgcccacgcggaacactacatccggtcagtgtcacgaccatcagcataacgaccagaagaaacttctttttgcttctaaaaaaatctttcatctttttgtctcctcgctaagtttgcctacctttatattttaacttttttaaccaatctttccaagagttttttgttgtttatataattttcttcatgatatttaacgcgaacgagtataatcgtatcaaatttctcttcaaaactgtaaatatcctgtaccatcatgcgtacctgacgcttgattttattacgtacaactgcttttcccattttcttgccaacggaaattcctactcttgcatgatcttcttttcgcggcttcacataaatagcaaaggaaggacaggtgtaaaattttttgtaattcatgatttcggcgaattcctggctttttttcacacgatattcctttttcatgcagttcttcctttctgtcttccgcttccctgatgctgttatctgcctgctatacgctttcacagcatcatacgcttaatcatagcctaaatcaggggaaaaagcaataacgtacggcaggaaagcacctgaaacaggggaagcctttactttttacaaagcgaaaaaaaatcaccgcagggtgattttttatgctgataacacttttctacctttggcacgacgacgcgctaatactttacgtcctcctactgtagccatacgggctctgaatccatgagttttctggtgttttcttttgctcggttgatatgttcttttcacaagagccacctccacttcttctttatcattttatacaaattgagcattgctttaaaattatacataaaaactctgtcaaagtcaataattcgttaaaaatatttgaaaatacgtttatttgtcaatccatgccatttttcgacagaagacatgtgtaaaaatagggaacagcagcacgataaaggttgaaaccactacaaatataaagatacttgcatgaaaaaatagaatggtggagatcagcgcctgaagcagcagcataataccgtaaacaattctggtttccatacgcagcgacatgactgcataaagaaagataattcttgccgctacaagtacagcgagaattccaaagaacacagataaggaagaaatcttatccgcaattaaaacaaaggaaagcagcgccagaaacagttccagcagcagactcatctgataggttgagcctaggcggtgctgaatcgtgcgttttgtacttttttcaaaccaattcatattatcacttcctatgtatttatccttttcattatataggaagataaaaaagaacacaattccgcattgcaaattactgaagttttctattattcaaagagttttcaacaattcattctccaaccggtggaaaacttgacgctgcaaagcaatttacagcatgaatcagcgaatatccacaaacctcacaatgccgactggttttccacgcttcttccacaatgataaaaccaatcgttttccaccatgtgtggaaactgtagaaaagctttacatctcctttgtttatcgtatttctgatcagtgtagaaggatggaaaagtggagagtgataatacttgttttccacttttccacagaatcatatattccacaccctatttttccccatgttttccatatggaaagctgtggaaagtggagaaactcctttatttatcctgtttttaggatgttttcctgtggataacagcggtgtgaaaataaaatccgctggacattcttcacaacatgactcctatccggtggaaaactatcatcactgcgatgcttttcctgctatacacaaataatttccattttctccttgaaacactgcacttttcatcgctctctttgaatcccttcatcttaatcagaatagccgtggtatttttccacaatctatagtaaaatataaggtgcatgaaaaaggagtcgtttatgtctaattttgccaaggtacagcttgagcagatctggcagaagacacttcagctcataaatgaaagtgcgcattttgatgacgccgtattcaacgcatggtataaagaagattctcatctctttgatatagaggatgattttgcgaccattgttgttccttataagatcaacaagcagattatgatggattccattgatctgattcagcaaaagctatctgatgtactggatatgaaagtctcctgtcagatcctgctaaagagcgaagtggatatgcttcagccatcatctgtcgttaaaagaagaaatgaaatcttatttgaagacaaagtaaaaaaagagtataccttcgacagcttcgtcgtaggaaaaaacaaccgggaggctcacgcagcggcactatccgtatgctattatcccggtaaattcaacaacccgctgtttatattcggaaattccggactgggaaaaacccatctgctgcatgccatcggaaattatgttaaggcaaataagccggatgaaaaggttttgtacatttacagtgaggatttcgtcacgctgctgattgaggcgatgaaaaacaagacggttgaagatgttaaggagatgatttgttcggtagactatctgctgatcgacgatattcagcgtctgaagcagagcacctcgcaggaaatctttttcaatatgtataacaagctgatttccgacaacaaacagatcgtcattaccagtgatattcatcccacggagctaaaggggattgaaaaccgtctgatttcacgtttctccagtggtttatccgtatcggtaggctctccggaatttgaaactgcgaaagctattctgcagaaaaagatggaaggccgcagcgatgaaatcatgattgatgacgaggttctcgattatctggcaacccgctttgcaagtgatgtcagaaaactggagggaacgctcaacgagctgttctttaaagcaatattatataatcccgagcggattgatatcaccttcgcgaaagaaatattcaaagaaaatccgattgttgtaaagcaggaggatgaactaacgccgaagaggataaagaatgcggtatgcgaatactatggtctgaccagaacccagatcgaatcaaaatcaagaaccaaaaatatcgccaatgcgcgtcatatcgcaatatacctgtgcaggacgcatctggaaatgccgtttgccaaaatcggttttgaatttggaaaccgtgatcattccacgatcatgtcctcgtatgaaaaaatgatgaagctgttaaaggaaaaggaaacatttcaacaggcagtcatgcagattgaaagtaatctggggataaaatagctaagatatccacatgtttaaacttttcatccacagcaaaatttgttaaaataagcctatgttcaaagtgtttttatagcttttccacactttccacatacttattattgtttatttacttataaaacataaaagaagggagcatcacccatgtactttaaggtgtctaaaaaagaattctacaatgcattatctgtggcatcccgtgccatctctacattttcaccacttcctgcgttctccggtattaagattgacgcaaaagaagattgtctgattctgaccggaagtgattcggatgtatccattcagacgaaactgacaaaatcggaagaatgtgttcttgagattcgtgatatgggatcaatcgttattgaagctaagtatattctggaaatcgttcgtaagattgatgctgatgaaatcgagtttgaaatgattgacggttccctgactaaaatcagtggaaacactgcagagttcagaatcaatggaatgcgtgcaaatgagtatccggctatcgacttctccaaaccgaaggaatgctttgcattaaaagaggaaacactgaagaaagtgattttgcagaccagctttgcgacaagtgataaagaaacacgtccggtactgaccggtgtgaatttccactgtgaaggcaatacgctgcactgtgtcgctaccgattcctatcgtcttgcaaagaaaacgattgatatcagcgaatccctgaacttcaatatcaccatacctgccaaatccctgtccgaggttgttaaaacactggaaggtgaaggagaggtggaaattgcagtcaatgataaaaaagcgcagtttatcattcatgacacaatcgtacagacgcgactgattgacggtgtatatccggaaacaagccgactgattcctttacagtttgactacgagctgacaatcgattcccgtgatcttctcaatgctattgaccgtgcaagctttattaaaaatgacggggtttccgttattaaattcagtctgagtgagcaggaatgcgtgctttccagcaagtccgtggaagtaggatcctccactgaggttttaagcagtgccagcttcacaggaagctctctggaaatcagctgtaacggacgatatgtctttgacgcaatcaaggcattgagcggcagtctggtaaccttccgcctttgtggagaaatgaagccgtttatcattaaatctgtggatgatgataatgttttacagctggtacttccagtcagaacctatgcataaacaacaggcagtaaggggaacatcctgctgcctttttctatgtattttaacaaaagtagacctttttcaggaatggaacgcagcgtttgaaaagcgaataaatttacatgtgaaaaatgatgcagaaaagtttgaaaaccataggaaaaactaacaaaaaacctttaaatatgatataatatataggaatgtgaaagaggttttataatggatataaagataaccggtgaatacataacattaggtcagctgcttaaaatgacggattttatccagagcggcggtgaagcaaaatttgcggtaaaatccctgaaaatcaacgtgaacggggaacaggaaaaccgcagaggacgcaagctgtatgcaggtgatgtcattgacattgagggcagcgtattttctttgtcatgagactggaatcacttcgtcttcataattttcgcaattatgcagatgtaaatgtcagttttaccgacggcattcatattctgacaggaaagaatgcacagggaaagaccaacctgctggaatctatcctttatttatcaacgaccagatcccatcgaaccagtgaagataaagatctaatcaaagaaggtgaacaggccttctttattaaagccttgattgcaaaggaacagaaaacggaggaaatccgtgtgacggtaaatgaaaaggggaaaaatctttttatttatcagaatcccgtgaatcgcgtcagtgacttcataggtgaatttaactccgttatgttctgtccggatgatatgaatctgtttcaggcctctccccgcgtcagaagacgctttgtggacatggagctgagtaagataagtaagaagtatgtatcaacgctttacgtcgctacacggctcttaaaagagcggaatgcttatctgaagcaggaacgggtggaccgctcctatctcgaggtcttaacctcacagcttgtggatgcatctgttgtcatcatgaagcagcggcatttctttctggaggagctgctggacaaatgcaggacattttaccgccagctttccaatgatgatacggatataacggtacgctatcttagctgtgttcctttctcggacagtgaggaagcgctgaaggaagctctgctgaagaaatatcaaaagcatcaggatcgtgacctgctgttgaaacagacgacggccggtattcataaagaggattttatctttgaaatgaatgggcacgagcttgtcagctttgcttcccagggacagaagcgaagtgtattgctggcattgaaaatcggtatgattcatatgattcatgaaatcatacaggaatatccggtgttattgctggatgatgtattttcggagctggacagctatcggaaacaggaattattaaaatctctgcccaaagaggtgcagattttcatctccacaacagattttgtggaaatggatgatatgaaaagtgatcgcagagtcacgttgtggaatgtaagcaacggtacaatcgagagatgttaggaggatgaactatggatgagaatcagatgaaagaaatcgaagaaatggaagataaggttgatcattcttatacggctgatgatattcaggtcctggaaggactggaagctgtacggaaacgacctggtatgtatatcggttctaccagtgagagaggtcttcatcaccttgtctgggaaattgttgataactcgatcgatgaggctcttgccggattcgctacggatattgaaataacgattgaaaaaaataacatcatccgtgtagaggataatggtcgaggaatgccgacgggaatcgttgaaaagacaggaatatccggtgtggaaacgatttttactgtactgcatgccggtggtaaattcggcggtggtgcttataaggtttccggaggtctgcatggtgtcggtgccagtgttgttaatgcattgagtgaatggctggaggttaacgtacatcagaacggacatgagtttttccttcgttttgaagacggaggcaaggcaacaggacctttgaaaatcatcaatgacagcgaaaagcatggttccattgtgcgtttcaaggcagatcctgaaatctttcaggaaacacaggaatatgattttgatactttgaatgcacgtattcgtcagctggctttcctgaacaaaagcattcgtctggtgctttgtgatgaacgggaagcggagccgaaacgaattgaatataaatacgatggcggtatccgccagtatgtggaatatctgaacaagaacaagacgccgctgcatgaagaggttgtgtatgtggaagggatagaggacgggattcttgcggaaatcgccatgcagtataacgatggctacattccaagcatctattccttctgtaacaacatcaacacgatggaaggcgggacgcatgaggatggcttccgactcgctctgacaaggattatcaatgcctatgcgagagagcagggaatgataaaaaaagacgagacactggctggagatgatgtgcgtgagggattaacggctattatctcggtaaagcaccccgatccgcagtatgaaggacagacaaagacgaagctgggaaactcagaggtacgaaaaattgtttccagtatactgggtgaacagctggatcgtttcttcatggagaatccggaaacagcaaagattattgtagataaggcgattcttgcgagcaaggcacgtcttgcggcaaaaaaggcaagagagctgacaagaagaaaatcagccctggaaatcacatcactgcccggtaagcttgcggattgttccagcaaggatgcctcggaatgtgaaatctatatcgtcgagggtgattccgccggcggaagtgcaaagcagggaagaaattccaagtttcaggcaattctgccactgcgtggtaagatattgaacgtcgagaaggcgcgtttgcagagaatcttcgaaaataatgaaattcgctctatgatcacagcattcggctgtggaatcggagaggaaatggatgtcagtaagctgcgttatcataaaattattatcatgaccgatgccgatgtcgatggtgcgcatatctgtacactgatgctgacgttcttctaccgttacctgcgtccgatcattgagggtggctatgtatatatcgccatgccaccgctgttcaaggttgccaagggaaaccgtgtggaatatgtgtataaagaggaagaagtggaaacggtacgtgcttctatgggggagaatgtaaacgtacagcgatataaaggtctgggagagatgaatccggagcagctgtgggagacaaccatggacccagcattccgtacgctgaagcaggtaaatattgatgatgctatggaagctgacagtatttttgaaatgctgatgggagaagaggttgaaccaagacgtgactttattcaggaaaatgcaatctatgcaacactggatatctaaggaggtgtaagggaacatggatttaaacaaggaaaaactgattcaggtagatatttcaaaagaaatgaaaacctcctttctggactattcaatgtctgtaatcgtagatcgtgcactgcctgatgttcgtgatggaatgaagcctgttcatcgccgtattctgcatgcgatgaatgagctgggaattgtggcaagcaagccgtttaaaaagtcagcgcgtatcgttggtgaagtaatcggtaagtatcatccgcacggtgatacagccgtatatgatgccatggttcgtatggcacaggacttcagctaccgctacatgctggtacagggacatggtaacttcggttccatggatggtgacggtgcggcggcaatgcgttataccgaagcccgtatgtctaaaatcgctatggaaatgatgaaggatatcaataaggataccgttgatttcatacccaactatgacaatgaggaaactgagccggctgtgctgcctgccagattcccgaatctgctggtaaacggttctgtcggtattgcggtaggtatggcgaccaatataccgccgcataatcttacagaaacaatagacgcaacctttgccattatggataatccggagatttccgttgtggagctgatggacaattatatcaagggtcctgattttccaacaggcggtatcattctgggaagagccggaattcgacaggcatttgaaacaggccgcggctctatcatggtacgcagtaagcatcatctggaggatatgggcaacggtaagacaagaattgttgtgactgaaatcccgtatcaggtgaataaagcgaatctgattaccaaaatcgcagacctggtaagagaaaagcagattgaaggtatcacctatctgaatgacgaatcaaaccgtgagggtattcgaatcgtgattgagctgcgtaaggatgctcaaccggatgttattttgaatcagctgtatcgtatgacacagcttcagacctctttcggtgtcaacatgctggcactggtagagaaaacaccgaagcagatgggaatccgggaggcacttcagcattatgtgaatcatcagattgacgttacggtacgccgtacaaaatttgaattgaaaaaagctgaggatcgtgctcatatattggaaggtttgcgtatcgcactggatcacattgatgaaattattcatctgattcgctccagtcagaatgatgcggaagcaagaactggtctgatggagcagtttaaactcacggagattcaggcaaatgcaatcctggagatgcgtttgcgtcgtttaacaggcttggaacgcgataagattgaaaatgaatatcgtgagctgatgaatacgatagcagatttacgtgatattcttgcaaaccatgatcgtgttctcgggattatccgtgatgagctgactgaggttaaaaatcgctttggcgatgagcgtcgtacagaaatcagtgaggcagattacgatatgcaggatgaagatttaattcctgttgaggatgttgttatcacaatgacaacaaacggttatatcaagcgtatgccgacagatacctatcgtacacagaaccgtggaggccgcggtgtgaagggtatgtctgtaaatgaggatgatattgttgatctgctgattacaatgtccactcacgactatctgatgctgtttaccaatcttggcaaggtttaccgtatcaaggggtataaggtgccgaattctggtagaacggctaagggccttccggtcgtgaatctgttaaatctggacaaggaggagaaggtgcgtgcacttgttcctgttcgtccggatagtgaatcctccttcctgctgtttgtcacaaagaacggactggttaagcgaacaccgatgagtgaattcgattctatacgtcagaatggtaaaatcgccattacactacgtgaatttgatgagctggttggtgtgaaggaaacaaccggagatgatgaaattattatcgcaggctccaatggtaaggcagttcgattccatgaagatgatattcgtgctatgggacgtacggcaagcggtgtgaagggctttaatgttgatggctcaatcgtagtaggtgctgccacttctaaagagggaacacatctgctggctgttagtgaaaatggttatggtaagcgtaccgctattgaggaataccgtctgacaacacgtggagcgaagggtgtaaagacaatcaatgttaccaataaaaccggtgagcttgtttccgttcgcgctgtaaatggtgatgaggatgccatgattgttacaaactccggtattattatccgaatatctgttgatgatattggtatttacagccgtaatactcagggtgttaagctgatcaacgtggcagatgaagaatctgttgccaaggtggctattgttgaaaaggaagaagaggagccggaagaggctgcagctggtgaagctttggaaaataatgaagaaactacggaacagataattgacaatcctgtagaagaatgatataaaataataaaacgttgaaaaggtcaagtaagaaagcaggctactttcagagatataacggtaggtgtgagttataatagctgcttatgaaatccgcctttgagtgaatcaatgaactattagtagttgattacggtagcaccgttatagctatgagagggtatatctttataggtatatcaaaaagggtggcaacacgaggtatcgtccctttatggacatacctcttttttatattctaggaggttatgattatgcttgatatgaaatttttacgcgaaaatcctgaaattgtaaaagaaaacataaaaaagaagtttcaggatcacaagattgagcttgtagataaagtgattgctatggataaagagaatcgctctcttaaacaacgaggggatgagctgcgaagcaagagaaatgctatgagcaaggaaatcggcggtctgatggccaaaggtttaaaggatgaggcaaatgctattaaagccaaggttcagactatggcagatgaaatgaaggaaacagaggttaaggaaactgagcttgctgagaaaatcaaggaaatgatgatgcagattccaaatatcattcatcctacggttccggtaggtaaggatgattcagaaaatgttgaactgcagaagtacggcgagcctgtgattcctgattttgaaattccatatcatacagatattatggaacggtttgaaggtattgatctggatagtgcaagaaaagttgcagggaacgggttctattatctgatgggagatattgcacggcttcattctgctgtcatttcatatgcacgggattttatgattgatagaggatttacatatgttgtaccgccttttatgattcgtagtaatgttgtgacaggggttatgagctttgcggaaatggaaggcatgatgtataagattgagggggaggatttgtatctgatcggtaccagtgagcattctatgattggaaaattcattgatacaattcttgatgagaaaaaacttccttatacttatacaagctattctccttgcttccgtaaagaaaaaggtgcacacggtattgaagaaagaggagtttaccgcattcaccagtttgagaaacaggaaatgattgttgtttgcaaaccggaagaaagtgcagactggtttgtaaagctgtatacgaatactgttgatttattcagaagtctggatataccagtgagaaccttagagtgctgttccggtgatcttgctgatttgaagaataagtctgttgatgtcgaagcatggagtccacgtcagaaaaaatattttgaagtgggaagctgttctaatttgacagatgcacaggcaagacgtcttggcattcgcgtaaagggtgagaatggaaaatattttgctcatactttgaataatacggtggtagctccacctcgaatgctgattgcttttttagagaataatctgaacaaggacggcagtgtgaatattccggaaaaattgcagccatatatgggaggcacaaaaatattgatgccaaaaaattaagcagtattgaaaaggtgatttttatataaatttcaccttttttagcatctaaaacagcttattatttgttggttaaaaatagcagaaaagcctttgtttatcgcattatttggataaataatacgatattgtgactctctgatttacatcgatatttgaataatcggacaattggtcatgtcgttgcaaatgattgcacagcttttttaggcatttttgtttcacgtgaaacaattaaggataaatcaagaattttcagctgttacttatgcttgttttataatgttttaaaagagataataaaaaatgtgtaagcaaatagaagataagttataatgatgctatacataaaaaggtaaccttatatatgaaaattatttttatacaaagtaggcgcaaatccaatgttaagacaatttcaaacattcttatgtatgcactaatgattttctaataataaaataagaaagcttccttcagttgtatcgtgtttgagaaaaggaagtatcaaattctgttgaataatataatggtgataagtactcaatgtagttatgttcaacctgagtttatgaactgtttagaaaattagcctgctcattcttaaagagaataaaaagtattccgttttatgacaatatattgtatctgaaatacaattcatattactatcttgttaatagctcagataaaaaaatagtgttaatcttaaggataaaggagtttcctttgtgaaatacaggatagacttgttcatcacttgtaaaagtcaaaatggcaattataaaatatgtgaaagcaaattaactgttgaaaaaatcagagaatatgctataatatataagctactacaatggtatctactgaattaggtcagattgggaacaaagcagccttaagggagctctatcatgtgtggtagcccttttttatatctgaggtaattttatgaaagaagaatatatgcgggctgctttaagagaggcagagaaggctaaaaaaatagatgaggtacccattggctgtgttattgttaaggatgataaaattatagcaagaggtcataatctcagagaaacaaaacagcagtcaataaaccatgctgaaatcattgcaattcaaaaagcttgtaaaaaggtaggaagctggcgtcttgaggattgtgatttatatgttactctggagccctgttgcatgtgtgccggtgctattctgcaatcacgtatcagaactgttatctatggaactgctgatccaaagggtggaagcattgaaagtaccttgcatatgtatgaacagccgggatataaccattatccgaaagttgaatccggtgttcttcaaaacgaatgttcacagctcttaaagaatttctttaaagaaaaaagactaaaaaagaaataaaagcaaatactgtaagaaagaaaagtatttgcttttcttatgtaaaattcattgtcagcatgatataattgacagtggagaaagcaggtgaagtatggcatataaagcgttatatcgtacttatcgtccaaacagttttgatgaagtagcaggacaaaagcacgttgtacaaaccttgcagcatgcagtggaacagcataagattgcacatgcttatttgttctgcggcccccgtggtacaggaaaaacatcaattgcgaaaatctttgcgaaaactataaattgtgagaatccaaatcataaaccatgtttggaatgtgataactgtagggcagtacaggatggaagccatccggatattattgagatagatgctgccagcaataatggtgtagaagaagtacgtacactgatagaaaaagttaagtatgcgccattgaagggtaaatataaaatttatattattgatgaggtccatatgatgtcaacgggtgcatttaatgcgctgttaaagacgattgaggaaccaccggaacatgttatttttattttagctacgacagagccgcataaggtgctgcctacgattatttcacgttgtcagcgatttgattttactaaagttccacgtgaagaaatcgttcagaggatacatactattctggagagagaacagattacgtgtgaagaggaagtaattcggattattgcacagcttgctgatggcggattgcgtgatgctttatctattcttgatcaatgtattgcttatgcacagaatcatatccaggtgcatcatatcaatgaaatttatggcattacaaccatacaggaaaaattagatttgtatcgttatatctatggaaaagatgcagtatccctgttaaatgcgatagatcagcttattgaaaaaggtattgatatcaaaaggctgactgttgatttaattgaaatattaaaggagagtatcattttcgagtatacaaaggatgcatctctgctgcatattctaaatagtgaagaggttttaactctgattgatggaaaatctattgcagagaggtttcaaatgatacatcttctaatggaaacatatgataaatatagaagtgcagcaaatgcaggatcttattttgaggtctgtttactgcaaatgctggatgtaaaggcaactgtggtgacaacgacgatatcacatccattggagactcctaggcaggaacaaaaaccagtaagcactgttaataatgtttcacgtgaaacatctaagaagaaacctatacttgaggttcctatggatgatgaaccatttacaccatatgatacaccagtatttgatccagtaacaaagagtgcgaagtcttcacatataccggaaaatatagtaagcaaggaaattactgctgtttcaacaaaagctttaaaaccattggataatgaatttgttcttggacttcttgccggggcaaataaacctgaaaaagcaaaggatagtcagcattttcagaaaatacctgaattcatgctcgattttaaatatgctaaatatggaagtcttttaaagaatgcaggtattgtaggcagtggtaatacctatatagtggtatgtgtcgataatcaggcagtagcaaatgaaataaatgagatggacagtaaaaatgaatttcatgatttcattactgaattgatggaaaagaataaaaaaatatttgctatttctgctgatcagcagaaatatgttatcaaagagtttaaagaccgtatgattgcaggtacattgccggagcctatacagattgaagctgtgacgattgaaagaaaagaagtaaaagaattaacacaggaagaagctgtattggatttgttcggtcaggaaaatataataataacggaggaataagattatgaatatgcagggattattaaaacaggcacagaaaatgcaaaaggaacttactaagctggaagatgaattaaatgaaaaagtatatggaacaacaatgggtggtggcgttatcaaggtagaagtaaaaggaagcatgtctgtagaaagtatctcaattgatgaaagcttgctggagaaagataacaaagaagatttagaggatatgctgaaatctgccttgaatgatgcattcgctaaagcagtcgaggataaagaaaaaaatatgaatcaaattacaggcggagtgaaaatgccaggtggcttctaatgtatcctaagaaatttgaagcacttgttgaatgctatcggagactaccgggtgtaggaataaaaactgcagaacgctatgcatttcaaacgctcgaatgggatgatgaaactatggactcttggattcatgcatttcaaaacgcaaaagaaggcttaaaaaaatgcgcggtatgcggcaacttatcggaagatgacacatgtgatatttgtggagatcaaagtagaaatagtcagattatatgtgttgtacaaagtccaaaggatgttattgcaatggagaaaacaaaagaatactctggagtatatcatgtgttgaatggtgtaatctcaacatcaaaaggtatactgcctgaggacatcaacatagactctctattaaacagaattagtgaggaaaccgaggaaattattattgcaaccaatccgacagtcgaaggtgaaactacagcattgtacttatcaaagctgctggaaaaatatccggttactgtaacaaggattgcacatggtcttccaatgggcggacatttggactatgcggatgaattaaccttgattaaagcaattgaaggaagaaagaaaatggaaccataatgttggttcttttctttactgtattataaaacgtaagaagtatatagtaaatgaggaaggacaggaataccctgctttcaaatgtatggatgtttaaatagcgtttaaatcaagaatatgaaaaagggaacaacctcctacagcaacagcaaaataggcgatacacagaaaaagcatcatcactatatgaactaattgtataaatccaaaatcaccagcaccttacatatatagaaaagaaatattttcattttactgcaagcgctatcatggtaaaatggatatataggaagaaggcgaacatatgggctcaattgcttatattactgataaaaatatgatggagtaccatagacttcatggtaactctgttatcaatttctggaagccaagtatcaaaagtattactgattttaaaaagggagacatgctgtttttcttgacaaaggggacagagcgtgggaaaaaaagagaaaagggaatacttggatacggtcatcttcgaaagcaacaaaacatggggtttacacaaatgtggaatgtatataaaactctgagtggctatccggataaggaatcattaaagcaggcaatctgcaaaattacaaaacaggaggaagtacctgagctactttcctgcatggaattagaaaatgttatctattttcaatatccgatttacctaagtgaaatcggtatgaaaatttccaataatattgaaagctttttctatatagataaagaggatatacaaaatacaggaagactactgcatctggcatcctctattggtacggatatgtgggtgaacagtactgttattacaaaggaaaagaatatgcaggaggatgctgtacttcaaatactggagaacctgagcagacgtatagagactagcttctattcagaatatgaagaatcaaaaatacgtcattatatacaaaaacttcaggatgcaaatatacagtcaattagaaacagtaaaacagagtattggacaaaacgcgatggaaaaataatgattttactgccatgcctcttaaactttatagatgctgaaagtaaaatgcagtatagcattggtcattatcagctatttaaagtatatataaatcaaagtgaatatgctgatcagatttccatcaaactattgttcaaccaaaagatccacagtaattggagacttgctctcagctatttaaagatagaatatgaagaaaggctagtcgaagaggactagccttatagctattacctgaagaatacaaaagaaagggaccataagaatgaattttgttttccttattttgtgtcggaaagcaatcattccaagaccaataccaaaagctcctccaaggaatgcatacagtaacagaaatcgctcaggtattcgataacgcttatgaatggctttccatttatcaattcccatcatacaaaatgaaatcacgttccagaagacgatgtagatcattcctccactgcctgcaaagcacgctgaatcttagatgtgcagtttttttcataaacaagctgcacatgagaaagaagcttctgaaaaacagaaagcccgtcatgtggctgcttatattcatattcaatttcataatctgtatgacttccataggtgctgatatcaaagcatagttcagcattctctgtttctacaacagctctttttgtcaccaaagtagttaacggaatgattgcagcttcaatttgatactcatgcaatagctgaacaatttcctctgattgcagagcatgaacactgttttcagatacttcacactcacactcgcacagcccatcaagattctcctgccgcatctttaatgtaaacagaaaccttccatttcgctcccgtatacgcattgcacccttctttttctgaatgtccccgtttaccgtatcataataggtattggtctgggttataaaattcagattttcatacaaactacacagcttatcaaactgttccttgttcacaagcattttatattctttttcaacatgtttattcatctttcatcaccttataggatatgatacaatagtaccataacaaaaggaagtgatttgtgatgaaatattcagtagttgcgaaaaaagatgcaaaatcacatgcagtagaggagaaaatcaaagagcgtctgcagtcttctggctggatttatgacaaagcagaaccacagcttgttatctgtgtgggaggagacggtacactgctgtatggcgtgcatcagtatctgcatcgaatcagcgaagtaaacttccttggcattcatacaggaacccttggctttttcacggactatacggaagaggagctggaggaatgcctgcatgatgtattggaaaaggagcctgtgatatttgaatccggtttattgaaaataaagctggataataatccaaacccttattatgcattaaatgagatgcgtgttgagaatattgtgaaatctcaaatcatggatatatatgtagacggtgagttttttgaaacctgcagaggctccggcatctgtctatccactcaggcaggctccactgcatataatcgatctcttggaggagcagttatagactgtggattatctcttatgcagctggcggaaataacagctattcagcactccaagcaccgctccctcggaaatccgtatatcatgatggagaaccgtcatgtaacaatgaaaagtgaaacctttgatacagcaatactctgctatgatcatttgaatgtgccgttggaagccaccaaagaaatctattgcgagatgtctgatcggaaggttagattcgcacgttatcgtcattacagttatttgagaagattaaaaaatttatactgacagatagtattgatgaagggatatgatttagtcataagctgcttcattagtctattcagttgcaggaagaacgaggattatcgcatcatgaaaagtaaaaaaacagatacgcgtggaatctgttttttatatccgttttttcctgtaccaaccattatttacttttgagaaatgtatcgtataacaaatatcaataaattgaagtagcatgcgcatttcatccgttataaaaaaagcaagcaaaataaaaccaatcacaaaacttatgattggcttattcatatacataatcagagagcttttttgcttttgcactggcattcataatgattccaaatgcaatcagatatgacagtaatgatgaaccgccatacgatatcataggaagcgtgattccggtaatcggcaataaaccgattatcatcccgatattttgtatctgttgatacagcagcatccccagaatacccagaatgaaatacttttcaaacatattctttgacatgctggcaatacggcataaatgaatatcaagcccgagacacagaaccactatgaataatgttccgatcaagccccagctttgtccaataacagcaaagataaagtcggtctgtgcttccggtatggataccagctcgattcccataccatgacctgtaaggccggccgagccaagagcaagcagggccatatacagctgatgcccctctccattgatatctgtttccggattcagccatgctgttattcgtttcagacgatatcctccttcaccaccaatcagctcattcagaacattgaaatgatagtaatacatatagaagaataataccagcacaatgacaatcaggatacctatgatgacaaaccattgtttttttataccggaacatacgatcatcgccaccagtgaaatagcgataatcaataccactccggtatctggctgagcaagaatcagaaggatagggggaactgcccatttcgctacattcataaacaaagagaaatccatttcataggactctgttaatttgttattgttatgctcatcaatcacaccggcagttattaaaatcaaaacgattttcataaactcactgggctgaaaagaaccgaacggccccagcttaaaccaggatgtggcaccgtttgttgtgatgatcattcccagcagactgcctccggtcaacatattgtataccttaccaatcagcagcaccacaagacaaaccataagaaaccagtatcctatttttgcgaactgcagcatggaatcattaccgagatacataatcacaccgatcgcgattgatccgataataaaccacattgcctgcttcatcatatagtctataccggctgcctgaccgataataccaaaagcggaatagatggacagaagactcatgacaatcgttaaaatcaaatatgtaactaaaacaaaatcgaacttatccggactctttgccctggataatcctactttcatttgcaccactccagacaaaaacctttttgaaacaaggttgtacttattataacacggtttatatttcttatgttgcagcatggtcaattattttctgaatttctattaagaaatgagaataagcatacacagcaggttaggatgattgtatgaaaaaacaaaagcatataggattatacccaatggtcatgttataataataagcagtgagtggagttgataaaatgacaaaaaaagctacctatacaccgatgatgaagcattatctggaattaaaagaacagcatgaggatgcaatcatattctatcgtctcggtgatttttatgaaatgtttttcgaagatgcaaagacggcatccagtgagcttgatctggttctgacaggaagaaatgccggtgtagaagaacgggtaccgatgtgtggaattccacatcatgccgcaaagggatatatacagcgactgattcaaaaaggatataaagtcgcaattgttgagcagctggaggatccggcactggcaaagggactggtgaagcgggatgtcatcaaaatcgttacacccggaaccatcatggatgaagtaagtgatgagaaaacaactgtctatattgcttctctgcatgactttcaattcggtcttgccgtcatactctgtgaaatgacaaccggagagctgcgtgcgcagctgattgataagcatgtcatggcaatacagaaggttctgctgggaaacaatgtacgagaaattgtaatacaggagaagtttgataagaaaatcgtgaagatgatagaagaaatgcagacgattaccgtttcctatcataatgataacgcattaaaggaagaataccgtcatttgctgaatggaattgaagatgaccgtgtggaaactgcctttggcgttctcaccaattatctggatgaaacacagaagcgaaatatggctcatctgaatgctgttgaaatggtatatgaaaatgattttcttcagatggatttttcgacaaagcagaatctggagctgacctccagtctgcgcagcaattcacgctcacagacattatggagctttcttgataaatgccgcagctccatgggctctcggttattaaaaaaatggattgaatacccgctggttgatacagcgatgattaaccggcgtctggatgctgttgaatatttgaatgataactttattacgaaggacgaactgcgtgagcatctgggctttgtctatgatatggagagactgagtgccagagtggcctatggttctgcaaatccgcgggatatcctgcgactgatcaaaacgctggagcatacaccgcagatttttgaattatttcatgactgcagtgcctatgaggaatttcagagtatcgatccatgccgggagctgtacgatatgatcgagggtgccatcattgataatcctcctttgacattaaaggatggcggtgtgtttgtggagggctataatgaagagctcgatcaggtgcgcgaaatcggtaaaaacgggaagaactggattcttgagcttgaaaacaaggagcgggaaagaaccggtgtaaagtctttgaaaatcggatacaaccgtgtattcgggtattatattgaggttacaaaaaccaatctggattctataaaggatgaatttggttatgtcagaaagcagacactgaccaacgcagaacgctttatcacgcaggagctgaaggataaagaggacgcgattgtacatgcgcaggaaagaagtatccgtctggaagcagagctattcaatcaccttctgaatcaaatcaaggtatatctgcctaagttgcatgatctttcacatgcattggccacaattgatgcattatatgcacttgcagagatttccagtgaaaacggatatacacggccacagtttcataccggtcattccattcacatgaaggaggcaagacatccgatcctggatcgaatgatgaaaacaacacgttatgtttccaatgatctggagatgggtgaggacaatgacattctgatgattaccggaccgaacatgggtggtaaatccacctatatgcgacagaccgttcttcttgtcatcatggcccagataggctgctttgtccctgcaaagaaagcggaaatgccaatctttgatcagatattcacacggatcggcgcaagtgatgatatcatgtcgggacagtcaacctttatggtggagatgatcgaagcgaacaatgcattacagaatgccacagcaaattcactcattttatttgatgagatcgggcgcggtacctccacatatgacggtatggcactggcgcaggctatgattgaatatataatgcgaaatatcaaagcgaaaacgctattctctacccattaccatgagctgacagaaatggcagaaaagaatgcaggtatccgcaatgtgcatgtggatgtacatgaagaggatgataaagttacatttttataccgtgtgcttgacggcaaagcagataaatcctatggaatcaatgttgcacgtcttgcacatcttccttcctccgtgctggagcgtgccaagcagattctggacaatctggagctgcagccgaatatggtaaaagaggtgaagccaccactcgtcatagaaaaagagaatccgcagcacatgcaaatcatcaatcaggttaaacaggtagatgtaaataaaatgacaccgatggaagccatgcagtttctgtatgagctgaaggaaaaaatgtcatagaagagaactctgtaatcccggattacaggttttctgttttataagaaagaaggtgtacttatgggtagaatcaatcgactggacgaacatctcagcaatatgattgcggctggagaggtcgtggaacgtccgcagggtattgtaaaggaactggttgaaaactgtatcgatgcacacgcatcaaatatagaaatacaaatatcacagggtggtattgcgaccattacgattatagatgatggtgacggtatggatcctgaggatgccacgctggcatttgagcggcatgccacaagcaagctgaaagaggttaatgatctctggaatatacatacaatgggatttcgcggggaggcactgccttccatcgcatctgtttctcatgtactgctgcgaacaaatgacggcacaacctctaccgaggtggagatcaactacggcaagctgatcagtgccagaccatgcgggactccgaagggaaccatgatagaaattcagaatctgtttcagaaaacaccggcacgcttcaagcatctgaaaagtccgcagtatgaattttctcttatttcggatgtagttcagaagtttgccctttcccatccggaaatcggattctgcctgtctcatgatggtagaacggtttttaaaaccaagggcagcggtaatcttttggaagtacttatgcagatttatggaagagacagtgcgaagagtgcgatttcgctggatggaagtgatcaggattataagataaaaggctatatcatgcagccgcagtttaaccgtgcaacaaaatattatatgctgctgtacatcaatggccgtatgatacgtaattaccatttgcagaaggcaatactggatgcatactcaccttatatgccgaaggacagatatcccatcgttgtcattgatttactgatggatgcacagctggtggatgtcaatgtacatccgtccaaatgggaaattcgtctgtccaaggaaaagcagctggaaaagctcctctatgagacaattcgcaaagcactgcaggagcagcttgaggttccacgcgttaatattacaaaggaaaccgtaaaagagaaggtggaagagcaggagctgcagtttacgtatgaacgtgatgatagcatttcaagactgcatgaggaagtaaacgacagctttatacatccggaaaagaatgaaaagccctctctggatatggaagagctgcgtagaaaaatcgaagcagataaaaaccggagaaaagaatcagctgctccgatacagcctaagactaaggaaattcttcctgaaatccgggaagaaacagcatcctacgagtctgaggattcaacatcggtaaaggcggagacagaggaagcagatgtcaaggttcagcatgaggacactgacaaaacagaagtgctgcccgctgcccacaccgggtcggaggcacacacagaagctatagaaacagacatttcttcggatgcagctgttgcatacaaggaaatcagtcagtccgaggagcttgtctatgagaaaaaggcagaggtggaacagccacagcctttgaatccgagtctcccacagcttcgtgtgattggtcagttccacagctgctatatcttggcagagggtgaaaagggcctgtacataattgatcagcatgcagcacaggagcgctatcattatgaaattatcagaaagcagattcttgacggaaacaatgatacccagccgctgctgctgcctataacaatagaatctacgatttctgctgtttcgcaggcagatgatttgaacgcattgctggaacagctcggcatccatcttgaggtctttggagatcatacctttgtgtgccgtcagctgccgctgtggatgaaggatgttgaagaagaggcttttctctgcgatatgattgatatttgggaaaaggataaggaaatcagtctggataagctgcggaagcatgcaatagctaccatggcatgtcacagctccatacgctttaaccgcagtcttacactggatgaaatgaagcgtgtcatagaggatttagcacattgtgagcagccgtttcattgcccgcatggaagaccgacaatgatctgtatggaggataaggcattgatccatgaatttgaacgtggataagcagcaggaggaaacagcctgcaagcatatagctgcttgtagtcgctgccttttgaaatggcatacctctggctacagtgagaacggatactgtgaatactgaggatatcttgtgagagaacggagttaattatggaaaaagtactggtgattgcaggtcccacaggcgtaggaaaaacaagccttagtgtggagctggcaaaagcctgtcatggagaggttatcagcggagattccatgcaggtttataaagaaatgagtatcggaacagcaaaaataacaaaggaggaaatgcaggaggtaccgcattatctgattgatttctgttcctttacagaggaatacaatgttaaaatttttcaggagaaggccagagaatacatagcggaaatcaccaaacatgggcatcttcccatcatatgtggaggaacagggctatatataaagtcctgtctgtatgattatcagtttgtcgatcagccacaggatacggagtttatgaattttctggcagagcgaagtacggatgaaatatgggggatgctgtcagtcatcgatccaaaagcctgtgagaatctgcatccgcataacaggcagagaatcgttcgtgctcttgcgatggcacataccggagagaaaaaaagcgaaatcgttgagtcacaggagcaccgtcctgtttacgatgcctatatcataggtcttacaatggatcgttcgcggctgtatgagagaatcaatgctagagtcgataccatgatggaacagggactgctgcaggaaattgaacagctccataccctgcaggaggatgtctggagtctgcaaagctttcagggaatcggctataaggaatggaaagcttacatagaggacagggaatcagttgacacctgtgtggaacgtattaagaaaaattcacgtaattttgcgaaacgccagtatacatggttccgcaatcagatgcaggtgcactggtatgatgttgaagatgagaactatcgcgaaaagattttagaagatgtaaaagcatggatggagaactgagatggaaacacctttacagagaatggagcttctgattggagaaaacaatctggaaatattaaagcgttccaccgtcatggttgtaggtgtcggaggtgttggctcctatgctgcggaggcactggcaagaagtggagtcggaaccctgattcttgttgatggtgataccgttgcacccagcaatctgaaccgtcagatacatgccgtctatgctaccatcggtcgatcaaaaacagaggttatgaaggaacggatggaaagctatcgcagggactgtacaatcatctgcaaggatatattttataaggaagaggaaaatgcagtcctctttgataaaccggtggatttcgttatcgacgcaattgataccatgagcagtaagctttccttaatcacatactgcctgaaacataaaataccctttatcagcagcatggggatggcaaaccgtctggatccgacaaaggtggagtgctgcgagcttatgaaaacaagctatgaccctgttgcgaaaattatgcgaaatctgattcggaagcatcatataaaaggaaagattccggttgtgttttccagcgaacagcccagcgtacaaaccaaaatcataaatgaaaacggtgttaccagaaagcagaaaatgccgcctgccagctcaccgtttgttccgagtgctgccggtcttgcagctgcttcctatgctatgcgcatactgcttgagaaaggggaacaccatggacaatgaaactctgaaggttattcgtagccgtacatccctgcgtacctacgatgcgaaaccgctgcgtgaggaagaagaaaacgccattatcgagagtgctcttcttgaccctactgctggaaatcagatgctgtattccatgatcatcatccgtgatcaggaaaagaaaaagaagctaagtaagctttgtgactatcagatgtttatacaggatgccccacttgttattgtatttgtcgcagatcatcaccgctggtttgattattatcgcatgaacggcgtaaagaggtatgcggaaaagcacggattatcatttacatcacctgcggagggggatttaatgcttgcggtggaggatgcgatggctgcagcgcaaaacagtgtcatagctgcggaatctatgggaattggttcctgttatattggtgatatactggaaaattatgaaacggtaaaggatctgcttcagctacccgatgagaccttccccatcgcaatgctatgctacggacattataaacaagagcacaaaaaggtgtttagaaaacgctttgatagaaggtttgtggtatttgaggattcctatcggcagctgcaaaaagaggaatatgagcaaatgtttgccgagcgtgcggaaaaggaatttctgacacagaataaatacgcagcgaaaaactatgcacagcagttctatgcgagaaaaacgggagcctccttcagtaaggaaatgactagaagtgtaaaggaagccttaaaggcctggacaggaaaataacgtcttatcgctaacagactttatttggaaaggatattatgagacaaatagatgttgtctattcgccgatgtgtgaagctacagctgcaatggttgaaaagcttcgaatctggctggagggcatagacatacaaatcaatttaattccatatcatcagctgccatcggataaaaaaaatttgcgaaaatgtgaaaattgctttatcgatgtatacgatcgtggtcgaaaaatagacacggtaccgttgcataagcaacagctgtatgcagccctgcagattgaaagaaatgcagaggatgaagaacctgtattctcaaaatggaatggtttgacagaagagcagtttaaaaattgtttacataaggatgaaatttcattcatacctatcacaaaacataattatctcagagaaatgtcgatgtgtcttaccaattatccctttggtaatccctctgagcaatatcatcaaagctgtatatcattaaaatccaaggtgttttcagagatatggcaaaaggaagatattgctggaattttcgcagttttgaatgatagggtaattggcttactggaggtaatgccaagagagattttacaaaaatacggctatatgacaggaacagcagggaatagcgacagctatttgacaataggctgctacgaggttggatatggtgttcctcgggttgaaatgctggatgctctgatggagaacctggaaaaggtatatccgctcttccatcggaaatacctcgaaggtatcggtatttatgaatggagggatggattcaatccatactgggtatatgaaaaacatgggtacagcagaacggaaaaattagctgacaatattattgtaatgtcaaagaagctttgcaagtagtgcaatccatagcagatgagaagaggaacagctgttaagaatgcagggtactctgtgtcatagtaaatatataacatataaggaatcaaatttatcagtttatgatatttgattctttttattatgttcgcttaatttcttgttgttatagaaaagccttatgatcactgattgtatctataaatgaataaaaggaatgaagcatgcagcagcctttgagacagctgcgtcagtttctattgacatatagatagcactgcgatatagtgtatatagaggttcgatatatagagatacaatgtagtagtggaggttatctatggatgaaaaactaagacgtgtttatgtgccgatgacagaaaccggtttttatattctgttttccctgcaggaggaacgccatggttatcatgtaattcaatatgtgaaaaaaattacagataacgaaatcattataagtgcaggaaccttgtatggaactctttcaaaaatggaaaaggatcagctgatcaggtttacaagagaggaagaaaaaagaaaatattatcaaattacagagcttggcagtacggtactgcagctggagctggcccgtattaaccgcttatatatcaacagtaaaggaggatgctatcatggaaacaaagagaatctttagattcttctcacttgcggaatatggcgaagaacagaagtttctggaagaaatgcatcaaaagggctggaagctgaaaagctatacggttttcagggggtatgtctttgagaaatgcataccggaaaactggatttatcaactggattatcgtgatgaagtagaggatctgaatgcttatatacagctgtttcaggattgcggctgggagtatgtcatgatgtttaattccttctattattttcgcagaaaagagaatggggaagaaaacaattcggagattttcagtgatcgtgaaacgcggcgggaatattgtgagtctatttataagcgaagtgtatttcttaccttgttttgtgcaatcatattttctattatcatagttcccggtctgtggaaggctttgcaaatgtttgaaagagatccatggtttcttgttgtatattctttgatttccggtattatgctgtttgaactcctgtttttaataaaatgcacgctgaaattatatgcggcaaagaaggagcaggaaagcacttaaagcgatgcagtatgcttcataatctgttactttgtgtttacgaaaaaaccagagcttattcataatgaatgttctctggtttttattataattgttttacttatgcgcaggagtatttgttttactggttacgtgagatcaatcagtattagaatcaacaggctttatgaaaatgatatgcttatatagaataatttcgcttaccgaaaatcacagtacccaggcgaatcatattcgaaccatgcttcaaagcaatcggataatcatcactcatccccatggacagatagcggatctgctcacttccatattcactttgcagcttgtgaaagaggatattcatcctttcaaagcattcctcaatacggtcacggtccgcatccagtggaccaacacacattagtccctgaacatccaggtgtttatactgcatgcactgttttacaaaggcaggacattcttccatatacacaccagtcttgtttgcttctcttgatatatttacttcaatcagtaccggcataattttatcgattttcgcacactgcttttctatttcctcagccagacgcagactgtcgagactttggatcatatcagcgagaggaacaacatcctttactttattgcgctgtaaatgaccaatcatatgccattgatagcgatcatcatatttttcttttaattcctgtaccttattttcaccaaacacccgacatccgcaggcataggcttcatcaatttcttctttcgtatgtgttttacttactgcaatcagtgtaacatgatccggaagatgtttctgtatttcctgaagtttctttttatccattttgcatcacctgtatcatattatagcactattttgtatagatagaaaagaatctgtttcatatgcggaaaatgaagaagaaattagatattgaatcccaaaatgttatgcttatacgcgtttgcagtaatcctttattttacagttattttgtataggataggcagtgaatgtttactgcaaagaaaaattcaatatatgaaatggcaaaagacattaggaagaggcgaacatcagagaacagaaaagacagaatctattgactctgtccatctggcaggtatgctgcctgtatgttgaagggaatgaatgaagttccctaacactatcttatgcagggactggtgttttatacgaaaattttgatcgataaagaaaaaagagaatgcaggagcaatcttatcatattttttatgcattcttaagtttgtactgtgactgtcaacataaaagcctatgcgtgtatttttattatccatgtgtattgtatccagtaatcattcatcggaaccagtacagataagaccagagcaaagaacttaatagaaaagctgtgaggctttccttatgatggaaaattcaaagcttactcctcagtatgaattcataattatgcctgaaaacatattctgcagcttatcagtacacaatgctgtaaatagcatgagaaatctctttgtagtgcaatagctgattatgctataatgatagggtctagttaaaggagtgtcaggctatgaacaagggattgtttatcacatttgaaggaaatgacggaagcgggaaaacaaccatcagtaagcttgcatatgaaaagctgaaagagatggggtatcctgtactatatacaagagaaccgggaggcatagatattgcggaacagattcgcagcatcatactggacccggccaatacggcaatggatgaacgctgtgaggcattgctgtatgccgccagccgccgccagcatcttatagaaaaggtactgcctgcgctgaaggaaggaaaaatcgttctctgcgaccgcttcgtggacagctctctggtttatcagggaattgccagaggtatcggtgttgaggaggtctttgctatcaatcagttcgcaattgaagggcatctgccggatgctacggtatttctttctgttgattttgaaacaggactgtcccgcgtcacaagccgtggcaataaggatcgactggacaatgaaagtatggagttccataagctggttgcacagggctatgagctgatcaaagacaaatttaaggaacgtatgcatattgtggatgccaatcctgatgtggatacagttttgaacaatacagtagcctgtcttatggagattataaaaaaccatgtttaaagatattctgagagaacagcagccggtggtatatcacactctgcgaaatgctctggagcataaccgtcttgcgcatgcctatatgttcagcggtcccagcggtacgcctaaaaaagaaacagcatatctgctggcccagagtctggtttgcagggaatcaggcttcgcctgtgaggtatgtgatacgtgtgagcgtattgcacacaacgaatatgccgatatgatatatctggatggaacaagtgtttccattaagaaggacgatattctgaagctgcagcatgcattcgcaaaaaccggccttgaaaaaaccggaaagaaaatatatgtgctggatcatgcggaaaatgcgacaccggatgcattaaactccctgttgaaatttctggaggaaccgggaagtgatatgattgcaatactgattgtggaacagctggacagagttcttcctaccatcatatcccgctgtcagaatatcccctttaccccgttgagcgcatcacagtgccatgcggcggtacaggaggatctggaggcgctggatgcctatctgctcagcagcatgatccgccagaaatcggaaattctggaggcttcggaaagtgaggattatcagcatgcccgctttttaatgaagggaatgctggagcgttatctttcctcaccatatgatgctttgctgtttctgcagttggaaggctttccttcaaaacagaaaaagcacggaaagcaggcaatgctctatctgcttgatatgcttactatattcttccgtgactgtctgcgtggcagtcgtcggcaatcggatacatggtatcagaatatgctgaaggaatatcagaagaaaaacatggatatggcagcaattctgcagattctcatgcagacgaaggatacattactgcgttcggtcaacctgcagctgctcgttgatcagatgctgtacagaatgaaagaggtgacagaatgaatcagtcggaagacaggaacgggatttcaaaaggaaatccgaatccgaagcaggataaaaagaagcatcatgacagaggctttgaacagaaacgggatatgaagcatcatcccaagcatgacggaaaacccaatatgaagtcggaagcgaaggaaccacgacaggaagtaaagaaggaaatgaagcaggaacaaaggcctgcacaaaagccggagcacaagaaggcaaaccacaatgaacgcaagccggaaggcagagtttataaatacatcgcgtttgtatcctttaaggattcaaaaaaaatctataccttcggtaccgatgtggatgagtaccgggtgggtgatgatgtggtggttgaaacgattcgtggtctggagcttggaaaaatcgttaaggaaacagaaacctttttgtccaacggaatggagatcaagccaatcacacgcaaagcaacagagcgtgatttaaagcaggcacaggaaaatattgaaaaggccggtaaggctatggagatatgtgcggaatgtatccgtaagcttggattggatatgaatctgattgaagcggagtatacgctggattgcagtaaaatcatctttgtttatgttgcggatgagcgtgtggatttccgtgagcttctcaaggagctggcaagtatttttaaatgccgcattgagcttcgtcagattggtccccgtaacaaatcaaaaatcattggtggtctgggaacctgcggtatggaaacttgctgttccagatttatgaatgactttgatgtcgtatctatcaatatggcaaagaatcagctgctggcattgaatattcaaaagctgagcggacagtgcggcaagctgatgtgctgtctgaaatttgaagacagtcagtataagcggctgcgtgagggtctgccgaaaatgaattcccagattgaatacaagggaagccggtatcgaattaccaatatgaatgtactgcttcagcaggtaaagattgaaaataaagaggatgtacagtttctttcctttaaggaattgtggccggatatagatttctccgatcggtaggtgaacaaaatgaatcgtcagaagagctttgaaaatgaaaaagcaaccctgtatgtggtggcaacgccaatcggaaatctgcaggaaatgacaccaagagcattgaaagtgctggagtctgtcgatgtaattgcggcagaggataccagaaacacactgaagctgttaacgcatttcggtattcatacccgactgatttcccatcaccagcacaatgaggctcaaagtgcaaacggtcttttggagctgctgcgtcagggacaggatatcgcgcttgtgagtgatgccggctatcctttgatcagcgatccgggctgtgttgtaacacagaaggtaatcgaggagggctttaatgtcgttccaatatccggaagcaatgcgatgctgaatgccctggtatccagtggcatggacaccagacattttctgttttacggatttttgaaatccggtgaaaaggaacggattcgtgaattgtatgaattaaaatactatccgtttaccatggtcttttatgaagcaccgcaccgtgtaaaaaaaatgcttgcttcctgtcttgaggtactgggcaaccgcaatatctgtctggctcgtgagcttacaaaaaagcatgaggagtttctgagaggaactatcgaagaaattctggaaattgcggaggagcttaagggtgaaatggtaattgttatggagggctccagagaaaccaaggatccgggagaagattccgcaatgccgcttgttcatgaacagatcaatacctatattaaagaaggattgactaccaatgaagcaatcaagcgtgtcgcaagagagcgcggcctcagtaaaaatgaaatatataagcagtaccacggattatgttaaaatacctgaacgtaagtgaatcaattgtttgaactacgttattgagctgttaataaggattgatttctgtatggaacaggagttaatccttttttaaaaggagaagagcatgaatttaacaaaggaaccctgtctgtatgcggatatgctgcagtgcagaaatgcaggcgggttagttttatatgaaacagagacagccctgcttttacagggaagaatttcaaagattttatacagtgctgcggcagataatcaggcagggaaagaaatcgtggagcaccttccaaagcagtttggcatactggttgcccatgacacctatacggatccctggctgaaatccatgcgaaagctggaaagcgagctggagtgtgttcactgtgtatatgttgaggatgtaccccctgcagtagccctgccggaaggctttgtaataaataggctggatgcatcacatacacagaaaatcattgcattatacaggcattcaatgtaatctctggcaaatgaacagtatatcggtgaatgtctgcaggatggtatgtatggtgcattttacaagggtgagctatgcggatttatcggagtacatgagcaggaaagtatcggaattctggaggttcatcccaaatggcggagaaaaggactagctgtggctctggagcaggtgatgattggcaaacagctggagcgcggcagactgccctatggtgaaattgtaaaggataatactgccagtatccggcttcagaaaaaagcagggatgattacagatgaaaagcttacctactggtattttccctgaatattcataaaatcatcacataagggtatggcattcaagttataatacagatagaggtgataacatgagcaaactgctggttgtggacgatgaggaacgtatcagaagcatgattcgtaagtatggtgaatttgagggacatgaaattgaggaagcagtggatggaatggatgccatcgaaaagtgtaagcaggcggaatatgatctaatcattatggatatcatgatgccgaatctggacggcttttcagcggtaaaggaaatccgtaaggatgtgcagactcctgtcattatgctctccgcaagaggagaggaatatgatagaatccacggctttgaaatcggtgttgatgattatgtgggaaaaccgttttctcctaaggagctgatgatgcgtgtcagtgccatattaaagcgatatcatggtgatgtaaacaccagaaaaaaggatatctatacctatgaaggcttgaaaatcgattttacggcacgcaaggtctttattgatgataaagaggtggaaatgtcgccaaaggaatatgttctattattttatctggtacgcaatgaaggaatcgcactgacaagagaacagctgattcatgatgtatgggggtatgatttctatggggatgacagaacgctggatacgcatatcaagctgctgagaaaaagtctgcaggattacagccgcctgattattacactgcgcggagtagggtatcgttttgaagctgaaaaataaacaggtggcaggcgtcgacagaaaagagcgaaaaccaatcagcgtcaagtggaagatttttgtcacactggtgttctttattgtcattatcattgcagtactatggttttttcaggtattttttctggaaaaattttatatgtttatcaaatccaattccgtaaaaaaggccgccagtgaagtaaatgaagtcattacgcagaagctggatggctcactggatatggaatcctataaaacaaaaatttcaaacatttcccgcaatggggatttctgtgtcatcgtttatgatgaggatacgagcaaggatccgattatgggcaatgaaagcgatggcaaatgtatgctcagcaaatctgccagctatgctgcccatgcagatgttattgatgaactgaagggggaagccctgtcacagaaggatggaatagcttccagactgattgaggatactgccaaggtggaggtgccctttgaatcctttcgtttctctttgacaaaggaaggtcttatgataccgcgtccggaggcatttccatcacggcttacatcggatatcagagacaacggcagaaataaacagaatatgaaaatttccaagggtgtgcagaatatgacctacatcagtgtggtcacaggaagcaattcccatatgaaaatcagtgtgatcaatgcacagctgacaccggtaaatgctacgattgaaacaatcaagacacagtttatcatcattgcggcaatattgactgtagtggcgcttatgctggccttttatctttcaagaaagattgcacgtcccatcatctccattaacaacggagcgaaaacgcttgcgaccggtcagtatgatgttgccttcagcggtaagggatatctggaaattgaggagctgagcaatacgctgaactatgcttccagagagctgaggaaggtggagaatctgcggcgtgagctgattgcgaatatgagccatgacctgcgaacaccgctgacaatgatcagcggatacggggaggttatgcgggatatccccggtgagaacacaccggagaatgtacagattatcattgatgagacaaaacgtctgaccaatctggtgaacgatatgctggatctatccaagctgcaggcaggtgtacaggagctgcatgcggtttccatgaatctgacggatgaaatccgcagcatcatcgaacgctatgaaacccttttaaagcaggatgagtatgatattcgctttgaatatagagaagatgtcataattcagggagatgtgatcaagcttgatcaggttatctataatctgattaacaatgccatcaactacagcggagaggatcatcaggtcatcgtgaagcagcttcttgaacagggaagggttcgtatcgaaataatcgatcatggtccgggtatcgaaaaggataagcttgcgtatatctgggaacggtattacaaggtggataagacgcatgtgcgctcccgggttggcagcggtctgggtctgagcattgttaaagctgttctggagcttcataaggctgaatacggcgtacttagtgaagaaggagtaggaagtaccttctggttctctctgccttacagcaaaagccaaaacgaggatggatagtgtctgtatcaagctgaatcactagaaactatgataataaacacagctgttttaaaacgatgtcagggaggagcagcaggtacagactcaaaacaagggtgctcgttataaaatacataccatacatattcatatagaataaaaatatctgtggatgacatttcatggatattttttattaatcattacgtaaatggaagaaaaatatcaggaaaaatgcttacactttttcatgtaaataaaaaaaagcatttacagtcccacaaacactgaaattgaggtataataagtgtcagagcaaatagagatgaaggttcatctacaacataaacaatctgaatacacgtaaatgccgcgtgtattttctattgtcattgttctaggttaaggaggattctatgatcactagcattaagaaaagggacggacgtgaaatacatttctctccggaaaaaatcacaagagctattttcctggcagcaagcagagtagcacaggaggaaggcagcaaagcagattatgaaacagcggaaatactgacggagaaagtcgtaaatcttctgaataatacataccagggcacaacaccaaccgtggaaaatgtgcaggatgcagttattaaggtattgattgaaaccggtcatgcgagaaccagtgaagcatatatcctgtatcgtgcagaacgtacaagaatccgcagcatgaagacaaggctgatgaaatccattgaggaaattacgtttgcggacagcaacgatgcggatatcaagcgtgagaatgccaatattgacggaaatacggcaatgggtaccatgctgcagtacggaagtgctgtatccaaggaattctgtatgagtcagctgatgaatccgcagcatgcggcgcttcatgaaaacggagatatccatattcatgatatggattttatgaatatggggacgctgacctgctgtcagattgatttggaaaagctgtttaacggcggtttttcaaccggtcacgggcatctgcgtgaaccgcaggatatcaccagctacgcagctcttgcggcaatcgcaatccagagtaaccagaacgatcagcatggcggtcagagtatacctgcctttgatttttatctggcaaagggtgtcgcaaaaaccttccgcaaggaatatatcagtaatctcaacaaagcgctggagctgtttatcaatctggatgccgatgtgagagaaccgttcaaggcagtggagaaggaaacaggaaaaactgcagctatgatcatggacgacagcttcctgaacagcctgaatgccatgctgaaggaaaccttcggtcttggtgaggaacaaatcgagctgatcaataaattcgcttataaagaagcaaacgttgccacaagaagaaaaacctatcaggcaatggaagcctttgtacataatctgaacaccatgcattcacgtgccggtgcacaggtaccgttttccagtataaacttcggtacggatatgacaccggagggtagactgatcagtgaaaatctgatgctggcacaggaagcaggtttagggaacggagaaacaccgattttcccgattctgattttcaaggttaaggaaggcattaactataatcctgaggatcctaactacgacctgtttaagctggcaatgcgtgtatccgcaaaacgtctgtttccgaatttcagctttatggatgctccgttcaacaaacagtattacaaggaaggacatccggaaacagaaacaacctatatgggatgccgtacccgcgttatgggaaatatcaacggtccggaaattgcgacaggaagaggaaacaactcctttacctccatcaacctgccgcgtcttggaatcaagcacggagttgctgtaaatggtgatttcaatgaggctgctttctttaatgagctggatgaaaagatggaaatcgttattcagcagctgctggagcgtctggaaattcagggaagaaagaaagtgaaaaacttcccattcctgatgggacagggtgtctggatcggcagtgagaatctgagctgggaggatacgctggaggaaatcatcaagcagggaacgctgacgattggtttcatcggtctggcggaatgtttaaaggcgctgatcggagaacatcacggagaaagtgaagaagcgcagaagctcggtctgaaaatcgtagggcatatgcgtgaaatgtgtgatgaagctacagagaaatacggtctgaacttctctcttattgcaactcctgcagaaggtctgtctggaagatttacacggattgataagaaaatctacggtatcataccgggtgttacagatcgggattactatacaaattccttccatgtaccggtatactatcacataacagcatttaagaagattcagaaggaagctccttatcatgaattcacaaacggcggacatatctcctatgtggaagtggacggagatcctacaaataatctggaagcatttgaatccatcgttcgctgtatgaaggatgcgggaatcggttacggcagcatcaaccatccggtagaccgtgatccatgctgcggctacagtggtgtaattgaagggcatgtctgtccaaaatgcggaagagacgagcgtgaggaagaatataagtttgagaaaatccgccgtattaccggttatctggtaggtacggtagaccgtttcaatgatgcaaaggcatctgaagaacgggatcgtgtaaagcatggatagcaaaaccatccgactggcttcccctatgcaggaggacagctttgtagatggtcccggtgttcgtatggttatctggacgcaggggtgcagacatcactgcccaaactgtcacaatccgcaaacctgggatacggaaggcggcaccctgtattccgtggaacagctgcagcagcagattcgtgatgcacagctgcagagcggtctgacactttcaggcggagagccgtttctgcaggttgagccattgctggaaatcgtaagaacggcaaaggaaaaacagctgaacatctgggcttacagcgggttcacctatgaagagcttcttgcggatgagcgtaagaaaaggctgcttgtgcaacttgatgtgctggttgacggtaagtttgtgaatgagctgaaggattaccgtcttgtctttaagggaagccggaatcagagaatcatcgatgtacagaaatcactgcaaagcggcagtgtcatcctgtcagaaaaggatgaacagaatcagaagctgaaggaagaggatatgatcaatgcatgaccatatcctttcttttatctctttctatagcataagaggaatagctgaatcatcgattctctgtgaaactgcaaacagcgtcatatgagccaaaaggaagagggaatgcggctgttcttaattactgcatacctttttccaaaggtgatactttgtgcccttgttattataatttcattctatacagaaaactttatagataattattttgatgtgtgaactatacaggcactgaagctgtacagcaagattgcatatatgcaatggaagttcttccataagattttaaggaatagattgcatgacagataagtgtgttgatacgaatataatgtaaaaggctgttgtaaaaggaaatatggggaattctactattggttgagaagcagacaacgagcagttgtgacattcaaccagctctatcttcctttaggaagaaatcatttctataatgagggtgtgaagaaaggtggaacactatatgaaagcattaggaaccaaaataagtgaattgagaaaagcaaggggtatgacacaggatgagcttgcagataaaatgggagtttcgccgcaggctgtatcaaaatgggagaatgatctttctatgccggatcttccagtattgattgagctgtcagacttcttccatatttctctggatgattttctaaaagaaaaggtgcagacagtcgaactgcttccggaagataagcgaaaggatatcgaacagatgtttttgagagtgtatgtgaattcagagaatggagacagagtacgtgtcaacctgccgctggttctggtaaaaatggccagagatatggggctggacatcccgcagatgacagacaatccaatgatgcagaaaatcgatctgggaatgattatgcagctgatagagagtggtgtgatcggaaagcttgtagaagtcgattctgcaaacggagatcatgtcgaagtgattgtcgaatagcatgaagatacggattcatgcacagtcctgccgtctaaatcttcgcattcccgatagcatgctttataatatgctcacctgtacagtgattagaaagacaatacaggagaatacggaaatagcatggacaatggataaggagaccacaagaaagatgatgcgtcttctaaagcatttcagtaaggaatacaggggattaaccatcgttgatgtagaaacggctgatggggaaattgtgcagataacattataaaaggatcatggctatgatcttttttctgtttacacctgtgctcctgaacaaagaagagaagcattttgaaaaaaagaaacaggtgccgttgacctgtttctaagctgcttcctatcttttactgattatgtaacatgcaaagctgtagttttatcttcagctaatgctgcattcttccagcagctgcagacagccgtccggattgtctgaatgaagaagcgcatttgtaaatcccaaatccatcagctttcttgccaggttggaaaggattctaagatgctcattcccgctgttttccttgcgtacagcaataccgaataccatctgaacctgatcatcatcccattgaattggattttgtagtcgaagaaagaccagagatgtatgcctgacgcccaatgacaatgcatgcggtatagcgatgctggagcccatggctgtagatatttcgtcctctcttgaataaacatcgtctatatattgctgcttatcacacagccgctgattattctccagtgtatccgcaatgcaggaaataatatcatccttggactgcagattcatatcaaggagaatcagattctcattgatcaacttcatgtcttactcctgatccggttcatttctgataaagaaataaatcatacagacagcaactgctgttcctgctgcaaacgataacagatataatgggatattgctgacaagaagcaatgtttccagaccgccaatcggtgcagatagtgtaattccaaacatggctaccaaggctcctgttactgctgctccaacacataaggaaggaagaattttcttaggccggtctgctacaaagggaatggctccttcaacaaagaaactgagtcccataatatatgcagcaatttttgccccccgtaaattttcgctgaactttttaggaaacagtgtacaggcgacagcacagcttgtagcaattaccatggcactgcagccgcaggaagccatgacaacagacggtacggttcctccatctgctgcagtcagtgttgcaacagagaacagatatgcagttttgttgatgggaccgccaagatcaagtgccagcataccgccgattactgccccaagcagtgcagcatttgtaccgctgagaccggacaggaaatctgtaagcgcattgctgacaggggcaacgacagaattgattgccagcatggcaagacttgttaatgcaagacccagtatcgggaataacagcagtgttttgattccctccagagatcgaggtatcccggcagtcaactttttcagaccgagaatgatataacccgctgcgaagccgccgatcacagcgccaagaaaactagagccgccgtttgctgccaaagcaccggctaccataccggtcagcaatcccggccgatccgctatggaataggcaatataagctcccataatcggaaacatataccccatagccagcccgccaatctgattcagccaggaaacgaaaacattggatgagccgaaggtcgctgtgttggcattctgaaaatcaaacagataggcacatgccagcataattccaccacctacaacaaatggcaggaagtaagaaacaccggacatcagatgattatagctttttttccaattcataattttctcctctttttcatttaatattcttttagtgcatcattcagtttttcatatacgctttctacttttctaacggcatctgttacagaaacctccagaagctttttccctctgaagcgctccatttccacacgggtatctgccgcaatgataacgtagtctgcttccttaatatcttcctcacgtaatcggttctctacacctccggaaccatttgtttcaatttttacctgaaagcccagtttcttaccctgccgctccagattctcagcggccatatacgtatgggcaattcctgccgggcaggcacatactccgataatgcgtttcataaacaagtcctcctttatgttctttctatctgtatcattctgagctcacccttacgcagaggctccagctcattggacagcggtttgtgtattgtatgatccagtgtcgtcagtgtgtaaacaagcgcttcatcgctatgtattatgccgcaggataccggctctatttcattgttatacagacgaagcagccagtaatctttttccttcaccagtgatccgaagcagccctgtagctcatccatattcagaaagctccaggaatccggaagtctctgttctggtggattggtaggaaaataggatatcggatgcacagacttatcaaaatgctgtccttcaaaacagagctgcgggcaggcatattgaatgtagtcttggcagatacgattaccgtcatagctttcataccacgttaaggccagatcaaagctgttttctttcagcatctgacattttggtgtttggaatatcatgtagtccagaccgctgggcctgcccggacgacgatgcagatccggatagcccatagcaccataggaacgaaacaatactacagcgatatccttgttaccttcgtctatcagctcatattccttactgcttttcgtcataacagtcatgacttcatcatcctctaccgatacataattcaataacggccatgttggactgggctcttcaaaccagccatccgccttccaggtctttaaagctgccggagcgctttcgcgtttgatgtagctgtattgtgtccctgcaagtgaatacgtatgcggtgcctgtccggtgaaaaccagacgtacacgatgatccgttgcatgattatcaatcgttcctgaaatacggatattattcttatctatcagctcaagcttaattttatatcgcataccggaatttcgtattctatcttttctattcttcagattctgaggtatctccaaggtacctgtcagggtcatacagctgtaagtcatattctgtacgcaggaaacttctgcatgttcaaagtaatctgtaagaatccagtcatattctggaggagaatagtcaaagctgtctccctcatccccggactcctccagatagatagcgctgcgatgctccctatgactcctgtaatcaaagatatgtacaccctcttcatccttgtgaatacggaaacggttattttcaatataaggaacctgcgccagttcatagctgacagatggctgatcaatatcctgaatatacaatgtgcgataggaaagccccttcatatgatcaatctgcaatatgatttctgtttcatagaaatagcccttgggatccatatcacggatatctttacgtaaaacaccacagttcttttttactgtccctgcacgcgtatacggcagctcctttccatccagaaggattcggaaatcaggttttccagtctgtacagttgtatgcagtgtctgtgttcttgtatatggcagcgtattgcataccagcagaggatatccatcctccctcttctgtacagaaagagaaagcagcttcatcagaaataccgtttgagaggttatcagattgtaagcattctgtgtttcctgctgaatatagtcatttgtttcatctgtcagtgtcgcagaggaatgtgtctggcagcgcagcagacgattccatatttcatcgatcagtccgtggtcatacgggataccctgtgcatccagcatggacataagaggctgaagaccgtatgtgatctttcgctcacaggcatcctgcagtgctttgatatctgcgcgtgcggagaaaatggaacggtgaacccgatgatactgcgtcgagaacagttcatgctcatggcattttaaattgtgaccatgctctcttacacgattgcagaagtcctgccatgttgttgatacaaatgcaatgtctgtttgctgtgcgttatactctgctattcgttttggtatatccagcattgccggattttgatcaaagcccagcggaaatacaaattcgtgatccagtgtggaataggacaggagccggtcaatcagactttgtacactgattttattgtagtcaagagctgattcatcaaataatgtaccattacggaatgcatagcatccgtatccatagcctgcaatcattgtgcataccagcagctcactgccgtcatttgatttcatgtaaaattcgctgccaagcttataatcatctccaacaccgcgtgttatgacaaaatccttaattccaaactgatgaaatatcttgggaaaatcccaggaatgtccaaaggaatccggcagatatgcaaccctggaaacatatccgagattttcggcagactgcatgccgagtctcaggttgttaatgacagattcaccattgcagataaagcagtcaagctgtgagtgaaagggtccgattacgagctttttttccgttacgagagttcgtatgtatgcttcgtcctccgggtgaagctttctgtactcatccatcggcgcactctgtccgtcgaaaaagaaatctgtaattcttccgcttcgaaagccttccagcatctccttcatattatagcacagctgaacagttgcatcctgtgctgtgaaataccagatcagatcccaatgtgtatgatgaatacaatgtgctgttttcttcattgctgttcctccttgcacctctactatatcaaccgctgtcttcaacaatcaatagagcacggcacttccttttttcaacatctacaggtattcctgcaattttttccagacagctgtatatagaaattatgatataatttctatggaagaaagcggatatcagatgctgtttattttaggcatacagctctcaccttcggtatgcgttccgaaagaaaagcagaaattaaatctgtatcttttccgcaggatcgagatagataccgtatggaaggctcttggcatactataatgggtgataaaaacaaaaaggacagtgaactggaggcttatcatgaaaaaaacacaaaggtggatggaacttctgaatatacttgtagaggaacagaattttcagactgtggcagagcttgcagaacaggtcgcagtatcttcgcgaacgatacacagcgatttgcaggataccagttttctacagctccttcatggtgccgagctgataaaaaaaccgaacatcggaatacgtcttcactgtacacaaaaacagagagaggcgatttaccggcagcttcaaaaaaatcgctttgagacatctgtccccttggaaaagggaaatgatttacatacggttctgcatatgcttttaacttatagggatgcgatccgtatggaggatcttgcagatgtattataccgttcaaagtcctcactgaccactgttctggaggaagctgagagacttgctgagaactatgactgcagacttcgaaaacgttcaaactatggtctgtctctggaaggacatgaagaggatatccgaaatcttttttaccgttttgtagacactcttccgatgcagggatatcagcataatgatctggatgtccgtctgccggatgcattatatgaaaaaatgaaaatggtatttgatgttcagatgattcggatgattatcccgattgtaaaatcatcggaaatcaatctgaatactcattattgtgattatgatttcggtatgctgattctcaaatgctgtatattacttacgcgctgtcagattgacaggtcagttcaaaagcagacaaccatcagcactgatcttcaggaatattatgtagccaccatcatgaagctgaaaatggagcagacatttcatgtaagcctacccgaagaggaaatatattatctggaacgggtgattctttcaacccgcaagcagcaaaaccaggagcagtttcaggagctggacagtgccatgctggatagattcatttatctggtatcggaacgtctgaatgtcgatctgtcagaagataaacagctcaaacaaaacctttgcaatcatatgaaaccggcaatccggagaatgaagtatggtatctcaagtgagaatcctctgctggaagcaatcaaaacgaaatacacggaggtctatgtcgcaatcatgacaacgattgataagatagaggaaagggaacacatctattttgacgccaatgagcttggctttatctgtctgcatatcgtcggagccttaaaccgctccagaaatatccgttccatacgctgtttattgatctgtgacgccggaatcacctttgaatcctatattaaaagcatggttgaaacatcctttcgtgaaatagaaattgtgaacattataggcagtgatgaaatgaaaaaagaaacggggcaccagcatgatcttatactgaatgctacaacgaaccgtctgcatgcttccaatattataaatatcgatcacttgtttacagaagcatcctgttcgcagattcgtcattggatttttgcaagagaaatcaagcatacgctggagcttcgcacaaagtttgacagctatctttcttattttcaggacagctgtgaaaatcgcagaagtctcattcataaatactgcacatatctggaggataacggatatgttacagaagcgtttgaggcgtcggtttatgatcgtattcagtattcctcaacagcaatcggacgtggtgttgcagtccctcacggtacgaaaaaagcagtgaagaattccgttattttaatcatcaaactggatcatacaatcacatgggatgatcagcttgttgatcttgtattctttgcggccatcggtgaggatatcagtacggaatacagtaaaatatttcgccgcattgtacggattgtctctgatgatgagcagacgcacatgctgaaaagctgtaacagtcttgaagaaatcagaaaatatctgtttgataccgaacaaaaagcataagctttttatatttgctcttgcaatcctttcagctgcgtgtaggatttatggtgaggtggttactatgaaagaattaaaaagctatatacaatccgtcaatacctgcagtgattcgctgattcgtgaggtgtggagtgatcaggatgaatgctccatgatatttccaaaaggggaagtggaaggactggacgctatccttgcttccttttatcacggagcgatggctcagtatgaaacgcgcgaccttcaacaggatgatgttaagattcaggaattctgtgatattacaattgtacgcttttactggacgctgtatgcgacgatgaaggacagcggggaacatatcatgaacaagggaagggaaacacagatttaccgcagctatccgcaggggaaaaagctggtgcatgtgcattattccagactgccgtaaggcatggcgttaacacctgtgaacattcgtatatatcgacatgattgctgaacagcagaacaagaaaaaagcacgatttttcacaaccgtgctttttctattgtctggaatgtagtgtttcacgagtctgttcatcaaaatccagaccttcaaactgcatatgataatacttggcataggtgccgcccttcgcaagcagttcattgtgtgttcctctttcttccatgccgttttcagagataacgataatttcatctgcattgcgtatggtggaaagacggtgcgcaattgtgatacaggttctgttttttgccagctcttccagacttttctgaatatgccgttcactttcattatccagtgcacttgtggcctcatccagaatcaatattcttggatccttcaggaagacgcgggcaatactgatgcgctgcttctgtcctcctgacagtcgtgtaccacgctcaccgacataggtatcatagccatccggcagtcccataatgaaatcatgaatatttgcctttttggctgcttcgatgatttcctcatccgtgcatccgggttttccatatgcaatgttttcttttacacttccggtaaacagatatacatcctgctgaacgataccgattgccttgcgaaggctttccagtgtcagcgttcgaatatcctgaccatccacacgaacagctccgttcttcacatcataaaaccttggaagcagggaacagattgtcgttttccctccgccgcttggtccgaccagagcaatggaacggcctgcttcgatatgtatagaaacatcatccaaaacatgctcttcctcattataagagaaggtcacatgatcataatctatgacaccctgaacattcttcagctcctgtgcatccggtgcatcctgaatatccggctctgtttcgatgacttcaaggaatcgtttaaacccggaatagcccttttgaaacatctctgtaaattcaacgagcacctcaatcggggcaacaaagatgttgatatacagggcataggtcgcaagagaaattggatcgagtgttccgttggcaataaaatatccacccgcaaccagaatcgtcaggtacagcatcccctgaaagaaattatttcctgcatgaaacagtcccatccggtaatagttattcgtcttagattgcagaaacagctgattgctgtgagaaaatttatcacgctcaatgtcttcattggcgaaggatttgacaacacggataccggccagagaatcctgcaggcttgcattgacaccggcaatcttacggcggttatccataaaggttgcctgcattttcttattctgaagcatactgaaaatcagcatgaccagcgttactgcaatcagaatcagggtcagcggtacgtggatgtacagcagcaacagaaaggaaccgataattttcaatagcgagataaatacattttccggtccgtgatgcgcgaattctgaaatatcaaacaaatcagaaaccagcttgctcatcatttccccggtattgttacggtcataataggagaaggacaggcgctcaaactgatcaaacagatcctgacgcatatcgctctccatacgtgctcccataatatgtccctgcgctgttacataataccggcagattgcacgaacgatatacattacaagcagtccttccccaagcagaagcagactgtccataatcatatcctttggttgaatataaaaggtagtattcagatagctcagaatctgcggaaatgcaagatcaaccgcactgatcacaagtgcacagaacatatcaagaaagaacacagtcttatatggcttataatagcttataaatttcttcataacttccatttaaaaatccctccgtttcgcatactgcattattatacacgaattagaagcggcttacaattcatatccactgattccaaatcgtataaaaacagctgtaagcaaaaaaggagatatctcccttctgcatgcggtctgtgaaaacatacgcaggcaatcatgcagtttagatttctcattccgatacaatggtaatttgattatcgtattttttaaatctggcggcagacgtatcctgttcgataagaatgatatcgccattggaatccttaacgatgtaggcatccttcaaatgtccggataggagcttgaaaacctgttcattaagctttttatatgtaccatgagatacacgatcaccagataaataataaagctgatcctcatcatccagactgatattcgtaaagctatcggcactggtataggttccacgaataccttttgtgaatcgatgctcttccttgcgttcactgacataggtgcctatggcatacagcacaataaaaaacaagcaggatacgaagatgaaagagattttaataatacggtactttttctctaaattcatgattttcctttctatgaatacctgactgcgatctacagcctctgaaaatatattgtatacagctgtgtaatcatcagtaatcattttaaccgtaatcatcatagcataccgtctatagggattaaactccatttaagcattattaagattgtttcaggcaagtctttttgcataaaatgagagctgccatgcaatataaaaaaatctaagtatttactttgaaaataatcaaaaaccccttataatgaaaaaaagggtgatacgatgggcatacgaatgttaacaatcaacgtgaatgggtatgacatacaggcaaaatacagggaagaggatatcaaaacagtatttatgccatttcttcaacatgtcatacagctgcaaaaggaatcaggaaaaagactcatagtctttctggcggctcctcctgcaacagggaaatccacacttgcgatagcactctgtcagtttgccagagaattgggctgtatggatatgcagtatgccggtatggatggatttcattatacgaatgcctggctcgataaccattttcaggatggaaaaaaactaaaggaactaaaaggtgctccggaaacatttgatgcagaagcaatgtatgcattgataaaggaaacaaaaggaagcgatacctggtggccggtatatgaccgtaatctgcatgagccgctgaagcataggctgcatattacaggcagtattcttcttgtggaaggtaattatcttctgttggacgagaaaccctatcgctccctttctgcactatgcgactattgtgtgtttattcaagcggaggaaaacctgctgcgtgacagactcattgacagaaaaagccgcggcgggctaagcaaggagcaggcagaggttttttatgaaaaaagtgatcgctgtaatgtacagcgtgtcttgcataaccgtttgaatagtgatgaggtgtggaagctttgtacagatggagggtatcggctcatttctcgcagcttcgacgaatcgtggcaaacattctgtgaatgagaaaggcagcgatacacattgccgtgatataaaggagattgcctatccatatgccggtacgcttcataatttgagagaatacaggctgggtagtgattttgtaaggactgatataaaacatattgatatccccgtaggaatgaaataaaacattgagcagtgtggcagctcctatgcagataagtaaaatcggaagggtttttataaaccctgaaagagaggtatcaccgtgtcttgaaaagccgatgaaacagccgacaaacagaagaagaatgtgccagacaaaggcatgcagcgtcaaggtgatataaggatgcatgaggccatccgaaccagcagcgccataagaccgccaagcagattgaaatccatcaggaaggtttccagaggaatcagccatctgctttttttcataaagggaagaattgcacaaagatacataggaagactgcatagctgaaaagggaaaatccaccagtcataggttttgttatccataacataaaaatgaaagagctgcttgtataattcggaaagcagtaaaataactgcaatagcaaacaatatacggtgatagctgcgatcactcaccctgcgcagcttccatgccagcgcaatagacacagggataccgactagcagcataacgatatgaaatagtccatagggctttggctcagccattgtccatgccgtcgcattcagaaaattctccatgcgatcacctcctgcctatagtatggacacgatagtatgaaactgcaatagaaaaagtgttttcactggaagcagcattgaatcaggaggtattccatactgcttagcaattttccttcctgtatgttcccccttgtgatacatagggatcgttccatgatttcacttgataaactgcatacccgctttatggttcatgcagacttgagaaactcaaatcataacagcatactgcgtctatcaattctgttatacatatgtccgctagaaagaaataaaagggatgctcctttctgccgtgagtgtgcaggcaggcgcatccttgttttatgtacgttgaaagcttgtaatcataatgaaaacacataagaccagaaagaggatcgatatccagttactgaaaaaggtacgaacacgggaacctctgttatgaattatataattccgtatgatcagtcttttctgatagagagtaaacatcgcatacagcagaaacagcgcttccagtataagaaagactgtagaaatctggccgttgtctgaaagcagtgagacttccatgattgcgaaagcgttattcagaaaatgaatcgctatacctggcaggatactacccgacgttaaaacaacatagcaaatcatcatactgagagcaaaaacagggacactctgcggaagatttccatgcagcaatgcaaacagcagacttgtcacaagaatagcgaagacatttccatatcttttcagcgtttgcagtatcaatccgcgaaagagaagctcttccatgatcggcgcaatgatacaggtggagagtacaatgcttagattgtaggtgatatccggcttcatggagaaatccggcgttgtcatgacccagccaaaatggatgaggatctgatttatcagctgtataagaattccagctgctccagacaatcccatagcgataatcgtatagcgaaggatggaaagaaaattccattccttgcatagagagtacggtattgttacatgcagcttctttttatatattacaagcgttaaaatcgttacaaagcaggttgctatcatactgaagatgtttgtgattgtttcaagctctgtttgcgaagcgcctgacatgatgtatgcactgcttatgattcctaaggtaaaggcacaggcaaataataaaatataatagaaaagcagagagccggctatacgtttacagtcctttttgcatagctgatctttatgttcctcttccagatacggctcatgttccattcggatacctcctatcggtcaaagagcttacgtcttgcagtagattgaataaacagctcctttagcccgtccacatcatcctgctccagggttgctttcagatgattgacctcctgtatgaaatcatcaatttcccgaatcaggttctctttattcagaaagaatacctcactccacagattctcgttgattttcgcaattcttgtcagatcacgaaaggagtcaccggtgtattctaccaggtgggtgttgtcattggtgttcataagagaaaccgcaatagcatgtgtcagatgtgaaacaaagccgatcatttcatcatgctgtgcaacggtcagctcggagatgttactgaatccgagtatttcggcaaactggcgcatggtcgcaactgcttccttcgtattgctttctgtgggcagaataatgaagttggcaatatggaagatggaatcgtctgcgaattttactccgctgacttccttacctgccattggatgggagcttatgaactccacatccctgcgaatgattttctgaatgggttctacaacacctgttttcacggagcttacatctgtaatcagagcaccgggcttgaaatatttctgataggtggttatccagtctaccgtcatatttggatatagtccgcttattatgatatcagcttcctttatatagtcaatatcaaatgttgaaccgcgatcgatgatgttatgcttgattgcatagtcaatgctgagctggttgatttcaatggcatcaacatgatagccgtttttctttaagcccatggcatagctgccaccgatcagacctaatccgacaataagaaatcgtgtattctcctgtatcataacagctccacctttccaccaatggactgtaaatcttcaaagaatgtaggatagcttttttgaattgcctgagcaccatcaatgatgcaggagatgttgctgcaggtcgctgcgacactgagcgccataacgatacggtgatcattatgggaggaaagctcgctcgtacaggtataggaggagttgccggtaataaagatttcatcctctgtggaatgaatatccacaccgaatttgcgcagctcctgttccattgcttcaatgcggtcactttccttgatacgcagtctgcctgcattgtagatattggtatttcccggggaatacatagcaaggacagttaggatcggcccgagatccgggcagtccgcaagatcgattctacagccatgcaggctgcttttataaatatgatagccgttttttacctcttcaatgcgtacaccaaagtcctttagtatcgagagaatttttttatctccctgcctggaatcgtgatgaacaccggtaatggtaagatcatgattgcatgcggcaagcacagcaaagaaggcaagctgggaatagtctccttcgatcgtatagtcacatgctgtatactgctgattgcccggaatatgaatggtcagatcatcttcgaaggaagcttgtatgccataggttttcagcatttgcagcgtgagatcaacatagcttctggattcaaagggtggaaggatgtgaatggtggaatcctcctgcaggagtggcagtgtgaacagcaatccgctgataaactgtgagctgacatcaccttgcaatgtaatatcaccggatttcagacattcacggatcgtgataccggatgcatcctgtcggaaggtgagcccctgcgcgtggaacaaatcctcataaaccttctgcgggcgctgcagcagtctgccttgaccggtgaaggtgatttcctgattgcagagagagaaaatcggaatgaagaaacgaagagtggagccggattcacagcaaaacacttctttgttctttattgtaaaatctttgattccggtaacagtaacctgatctgcttccatgcggatatcggcaccaagctgctgcatgccggcaatcgtggttttgatatcctgcgaataggcaacgttttttatgacgctggtgccgttcgccagagaggcacagataatcgcacgatgtgccatgcttttacttggcggaatgacaacatgaccactgcagatggatggtgctacatgggctttcatttacatcgccctcccgattacacctgcgatagcctttcccttgcggatcagctctttaaagttatccggcttgagagactgtgcgccatcactccatgcgcattccggatgatcgtgtacctccacaatcagtccgtcggcaccagctgcgattgctgcaagcgaagctgcctccaccagctcccaatcaccggtcgcatgacttggatcaatgataatcggaagatgtgtttttttcttgataataggaactacactcaaatcgagggtatttcgtgtataaggttcaaaggtgcggataccacgctcacacagcatgacattcgtatttccttcagaaagaatatactctgcggacatgatccattcttcaatcgtattggccagtccacgtttcagcagtaccggcttgtttgtttttccaacagcctttaaaaggtcaaagttctgcatatttctggcaccgatctgaatgacatcgacatactctacaaattcatccagcttatcggcactcatcagctcagtaacaacaggaagcccggtttgctttcttgcctgtgcaagcgccagaattccttctgttcccataccctgaaatgcatacggacttgttcttggcttgtaggctcccccacgaagcatcactcctcctgcatcctttacctcatgagcgatatgacaaatcatatctttcccttcaacagagcagggaccgccaatgacaacgattttttcctttccgccgatgtgaatgccgtttacctctactatcgtatcctccggatgaaacatccggcttgccttcttatacggggatgatacgcggacaacactttccacatgcttgttcgcctcaatgcgcttcgggtcaacctgtgatgtatctccaacaacgccgaagacattgaggttttcaccaatactctcatgaatctgaagccccttatccttcagctgcttcatgacatgctcaatatctgcttttgttgcacttttcttcattgtgataatcatatctgcttcctcctcttatatatgttactgtgccggtgttttttttatttcattgtcagggttgctgatcgctccatcagctgatccagaatgccaatggcaagcacactgtccacgacgattcttgcccgatgaataattgccggatcatgacgcccctgaatctgaagcttcactgcttcgtgagtctttaaatccaccgtattctgttccttatatatagacgctgtcggcttgataaccgtacggatgcgaatcggcattccattggaaatcccgccgttgattccaccattgttatttgtagcggtatgaaatcccttgtcataggtgatcggatcattggcttcacttccatacacatccgaaaaaccaaagcccagaccgaattcaattccctttaccgctggaacactgaataacagatgactcagtgtgctttccagcgaatcgaagaacggttctcccagacctgccggaacgttcagaatacagctctccagaataccgcccacactgtcgccttcatttgccgcttcctctatcatcgctttcatatctgcagctgctgtatcatccagtaccgcaaaatccattgtattgacacgttccacctgtttctgtaattcctctatattctcagaaaacggaatatcctctatggttctgcttttctgaatatggcttcctatcagaattcccttttccttcagtacctgcatagcgattgcacctgccgctaccagcggtgcagtgattctgccgctgaaatgaccgccaccgcgatagtcctgccagcccatatacttttcattggcagtatagtctgcatgagaagggcgcagccgatatttcgtcttttcgtaatcatgacttcttgtgtttgtattttcaatgagaatcgtcaacggtgtaccggttgtatgaccattgaaatagccactgacgatatgcagctcatctgcctcttttcgctgtgtggatattctgccctttgcttttcgcttttccatgacggaggctataaaatccatatccagtttaattcccggcgcaagaccgtcaatcacgcagccgatggcttccccatggctttctccaaaaattgtcacagaataattatgtccgaatgtatttttcatgcttgtgttcctttcaatatagtacgtacttcatcaagcggggtttctatcagttccgctgttcctgcctttggaacatgaacgatcgttacatgatcaccgtccgctttcttatctctgcataaaagctgatataccgcttccgggtcaaagtccacatgtgtggggatacccagacgctcatacacgctgataacacgctgcttcagctgttcatcctcgataaaatacagcattcccaaagcaacacattccccgtgcagatactcactcaggtgataatagctttcaatggcatgtccgatggtatgaccgaagttcagaatcttgcgcagtccctgttcccgttcatcctgctcgacaacactctttttcacatacaaagctttttcaataatcgtatccagatctttttcaatatctccatgctcaaacaatgcaaacagggaggcatcatagatcagtccggctttcagtgcttccatcaggccgttgatatagtgccttctgggaagcgtatgcaatgtttccggatcgataaagaccatttttggctgatagaaggcaccgacgatatttttaacctcatccagattgatagcaacctttccaccgatactggagtctatctgtgaaagtgtggttgtcggtatctgtatgaagtcgattccccgcatataggaggctgccacataacctgccagatcaccgacgactcctcctccaagagcgactacacaatcctttctggaaaacttgtgtgccagcagatcctcattgatttccttgaagacggcaaggtccttggaatcctccccctgttctatgacatgcacataccctttcttacattgttcccgtacgatatttgcataggcctccggtacgccgctgtctgtaacaatcatcaccttgcggtttaaatcaatatagtcatttaaacgatacagtatcccgtgttccatcaggatgtcatatccgttctcctttaaatcaacgtgtaatttcataacaatatcctcccttttatgaaaaaaaagcatcctgtgtgtatcgcagatgcttttgtgtgctcgttataaagtgaaaataaccatgacttcttcaatggctttataacggactattcaaagtaataaaagtatgctttctgtatcatggtcaaatcactccaattaccaatatgataatatactttatgcataattacaagaaaaaaacacaaatttatgaaaataatttcagtttatgaaaatgcaatgaaaacatgatgccgctattgctgatgacagagttaagacggtataggaggactctatacagctatccgttacagcacaatgagttttggatgatactatttgcacacaatttgtaaaacttttcataaattcatgtaagttttgaatttatgataggaagttaaatagaattattgtataatattgtggaaacaggggtgagtttatgagtttattggatgatgcccgaaaacggatcaatgcgattgatgaggaaatggcaaaactttttgaacagcgcatgcaggcggttgaagatgttatccgttacaaacaggcgcatcagatgaaggttttggatacatcaagagaacagtatgttattgaacataatacagcatttattcagcgtgaggaatacagggacagctacatagaatttatcagtgaaatgatggcaatctctagaaaatatcagcgatcgatcattaaccgggatcttatcggttattccgggacagaaggagcattttcccatattgctgctgagcgggtgtttttggatcaccgaaagaaaagctatgcctcctttgaagacgtatttcatgcagtaacggagcgggaagtggcctatggagtcattccgtttgaaaattcatatactggtgaagtgggagaggtactggatcttctgatgcgttatgatgtatatatcaatgatatatacgatttgcagatatcacagaatctgctaggtgtaaagggagcatctctagcggatatcaaacaggtgtattccaaggatcaggcgatatatcagtcaaagaaatttctggagggacgcggctatgagctgataccatatccgaacactgcgcttgcggcagagtatgttgcgaaagaaaatgataaatccaaggctgccattgccgcgaaggaaaatgcagagctgtatggtctggatatacttgcggaggatatcaatacaagtgaacagaatacgacacgcttcatcatcatcagtaaacagctgatacagcagggcaatcgcttctcgctcgcttttaccacacaccacaaggcaggtgcactcgtacatgcgatgaatattatcgctcagtatggatttaacatgcagagtattaagtccaggtcgataaaggaacgtccatgggaatactatttctatgtggaaatagaaggaaatctgaaggatgcaaaggaacagcatctgatccacgatttaaaggaagcatgtgaagaggtaaagatactcggagcatatcaaaacgatgaaagaaagcagggatgaatatgagttttgtaaaacagaacgtcaataaggcgccaatcgaagatacagtattcgctattgtgaaaaaggcaaaggaagccaaggctgccatcggtgcagagcaggttgtcgatgcgaccatcggctctttatataatgaagaagggaacatcgttgcctttgacagcgtgtttacaccttataacgaaatagcaaaggaaacaaaggctacctacgcggccagctttgtcggcaatgattctttccgtaagcaggtttatgaatggatcgtgggcggcacgggctcaactctggtacacagtgtgattgccacaccgggggggaccggggcagtagcgatcaccatgcaggaaatactggatgaaggggaaacggttattctccctgaaatcgcatggggcagctataggctgatggcgaccatggataatctgaaggtgaaaacctattctctgtttgagggagatcatttcaatgtagagtccttaaaggaagcctgccgtgaggttatgaaaacgcagaagaagctgctgctggtaatcaatgatccatgtcataatccaactggttactctatgagtatggaggaatggcaggagattgtggcattcctgaacgaatgtggaaaggaagtgccggtagtgcttctcaatgacattgcttatattgatttttcttatgatttagagcattgccgaaattatataaagacatttaatgatttttcagaaaatgttatggctgtaattgccttcagctgcagcaaggcgctgacctcctatggcttgcgttgtggtgccgctattctgttggcacagacaaaggaagctgtacgcgatgtggaaatcgtatttgagaaggcggccagagctacctggagcaatgtgccgaatgctgctatggaaaatttcacatatgttacaacaaccaattatgatgcgtatatgaaggaaaaggcgatgtatgtggagcttctgaaaaagagaagtgacatctttacagaagaagcagatgcctgcggattggattactatccttataaagagggcttcttcgtaactgtgagaatcgaggacaatgcattgcgtgatgtcttccacgaaagcctgatgaagcagcatatttatacagtaaaggtaaataagggcattcgtgttgcggtgtgctctctaagcagtgagaaatgcagagggcttgcgaagcgcatgaaggaaatacttgatacatgtaaatagacgcatattacattagcatgatatagataagcagaccgggtattgcggtctgcttttacgcttttcgtaatccgatgtattcactttgtatatcgtttttttagcttttccagttcataaaaatataatcctataatcggtaaatcgctttttgtaataatctccgcattctgactttaaaagctgcatcctgaataccatcttctaaatccggtaagacattgtaaaaagtgccgtttttttctgctgcttttctgaatttactatcatggagatacggagctgttatatatgacaaaatcaagcacgcctgttgttgctgtctgtctgggacaagtcaccatgaacgcttattcccatacataattccttcatcagagtcattgttatcgttcagtacttctcagcttcctgtaacttttccacccttataatggcgtagttttgcagctttacttaccattttaaatttcaattttacaattttcccatcttttcagtattcgaaggaatatgtaaatcagaatatacatcatagaaaccaaattcgtgcagttcgaatgaaggttatggtatagtataagaaaagaaatgagggatagcatgatactttttgtaagcggacgctgtgatataccggcattctacagcacatggtttttcaatcggcttcaggaaggcttcgtggatgttagaaacccgttcaatcctcatcaaatcagtcgtatttatctgaatgaacaaaatattgatggtattctgttttgtacaaaaaatccgattcccatgatgaacagactggaggaagtaccctttctctatcagtttcagattacgctgacaccttatcatgaggatatcgaggaacatgtagcatccaaaaaggaaatcgtaaatgcggtaagagaaatgtcactgcgactgggaaaggatcgtgtaatcgttcgctatgacccgatcctgcttactcccaaatataccgtggagtaccatcggcgggcatttgaaaagctgtgcagccagttggagggctatgtggatacaattatcatttcatttgtggatatgtataagaatacggcaggcaatcagaagcgtatgcagctacaggaaatgcgccgacaggatatgctggatgtcggaaaggcactgggcagtgtcgctgagcgctatgctgtacatatacaaacatgtgcagaggatattgatctttccccctatcatattcacaagggactctgtatggatcgtaaaaagcttgagagactggtacagcattccttggatcatattcagggaaagggtgtgcgatctgtctgtggctgcatgccgacggttgatatcggtgattataactgttgtccgcacggctgtcggtactgctatgccaattataatgaaaaacagattgcggaaagaatgaagctccatgatccgcaaagcagcgtcctgctgggacaccttgatgaagaggacaagattacgatacgggaggataagcatatccgtcagatttcactgctgtaggacgaaaatattttcaggtatgataagggaatcctaacttgaagtttctattgcataacttgttctatccatgccattttccttttgttcgtgattcatagcgtggtataataaacacacaagggagaatgaattgtttgccaattggtatagagaacttcaaactatgatagatgaaggttattattatgttgataaaaccctattcattaaggaagtgcttaatgaaaaagttgcactgtacacaagaccgcgtcggtttcacagaatagtatcgatacctttggtatccgacaagaggcgcgctagtagcgggaaaaacattaaatatgagtaggcgctgcccatccaggcgtgctatattatttcttttctatgaaagagaaagagaatgcgtatctttttgataatcttgaaatttcaaatgattgtgatgctttgcttcatcagcatgcatatccagttgattcatcaccttaaaggatatgaaaagagctgattataagatgcagattgagaaattcggttctataatttcagacattgttaatgcaaatccggaattgctgaatagtccaatgttaaatactgcacagaaaaatttgttgacacagtatcaaaatgagacctcaaccataagcaacttaatggatgctttgtttaaaatcagtatttgtatgcaactgcattttcagaaaaaagtcattattctgattgatgaataggcgctgcccgcccatggcgtgatgttcctttacagactgcatatttgaatggctactatgatgaaatggtagactttctcaggcatgtgtttagtgcagcccttaaaacaaatgatgctttagaaaaaggtattttgacaggttgcggacctaaagccgatggcagaaaaggcttgtgaacaaatcaaaaatcagaaatatatagagggattgtatgcagatggctatgaagatattataggatatggaatagcattccataaaaagtcctgtgtaattacatccttgaaagatatttgaatgctttacattaaaaaaagctgtgataactagaaagtctggtttcacggtttttttaaataattgtttgctatttttcatcgcttatttgttagtcgaaattataatgttctctgaaacctctttattgcgtcttatgattcaaaaattatcagaataaagatgcaagaaaatgctttttatggatataggatgcgtatggagttgatataatacgatatgataagtaatttggataggataattttgaaagtatatagttataaagcatgaaaaagaatacgcctatattctgaataaaccgcatacatatcccgtagtttcctcaggaatccgaaattgagaaaatcagataagaaaattcactttatctattgtaataaaatcaggtttctagtaaaatagacatgtattgacatacatgcttgtatataccctgtaataaggtcagggagtttctagccgttcaccgtaaacgaacgggctacaagcaaacaattactctttctttttgttctgggacgtacttgtttgctttttatattgcaggcaggtgcgtctttataatttttataggaggtcttacttatggtcttaagaagatacgctataacaattacacaatttaacggtttttagtgtacatattggtgaaaacgatatgtatttttttatttcaaggaggaaaaacaaatgagtgaaatcaaacctgtcgtcagtattttaatgggaagccgttccgacttgccaacaatggagaactgtttcaaccagctgaaggaattcggtattccttttgaagcacatgcattaagtgcccatcggacaccgaatgaagttatcaaactggcagaaggtgccaaggatcgtggaatcaaggttattattgcggctgcaggcggagctgctcatttgggtggagttatcgcatccagcacaacactgccggtaatcggcgttccgattcaaacaagtgcactgggtggaatggattccttgctgtccactgtccagatgcctggaggaatcccggtcgcaacagtcgcaatcggaaaagcaggcgcaaagaatgccgctattctggcagcacagatgcttgcgttaagcgacgaagcaatggctgaaaaaatggtcgcattcaaggcttccatggcagaaaaagtaatcaaagattccgtgattgaagtggaatagggaaaggtgaatatactatgaattatcgcgtatttgtgaagaaaaaggaagcatttcaggtggaatccgcttctttgtttcatgaactgaagcagaatctgaatctttcaggattgcagggtgtacagatgtataacgtatatgatgtcttccatggggataaacatgacatggagcttctgaaagaaaaggttctgagtgagaaggtaacggatgaggtttttgatgagattgatctgaagggaaaaacctttattgcatatgaatgcctgccaggacagtatgaccagcgtgcggacagcgcacagcagtgtctgatgctgttgaataacaagcaggatgttgtaatcaaaagcggacgtatcgtcattctggagggcagtgttacagatgaagaaattcaggctgtcaagaaatacctgatcaacccggtagagatgagagaaaaggatcttgccgtacttgggtatgaggaggatgtggagattgaaccggtacctgttttaagtggcttccgtgatctggatgaagcaggtctggaggcattgcgcagtgaacaggggctggctatgacgctggcggatgttcagcatattcagaaatacttcagggaagaggaagagcgtgatctgacgctgacagagctgaaggtactggatacctactggtctgatcactgtcgtcatacaacctttgaaacgatccttcagaatgtaaagattgatgcaggcagtctgcaggataccatacagaaggcatatgagctgtatctgaagctgagaaaagatgtacatgataataagaaatttgtgacgctgatggatatggctaccatcgcgggtaaatatctgcggaaaacaggtaagctggatgatatggaaatcagcgatgaaatcaatgcatgttccattgaagtaaccgtggatgtagatggtgaggatcagcagtggctgttgatgtttaaaaatgaaacacacaatcatccgacggagattgaaccgttcggcggtgcaagcacgtgcatcggcggagcaattcgtgatccgctgtccggaagaagctatgtatatcaggcaatgcgtatcacaggtgccggagatattacaaaggatattaaagaagcacttccaaacaagctgccgcagagccgcatatcaaagggggctgccgcaggatattcctcctacgggaaccagattggtctggcaactacctatgtaaaggaaatcttcaatgacggctatgtcgcaaaacgtatggaggtaggtgcagtcgtaggcgccgcaccaaaagaaaatgttgtgcgtaaaaaaccggaaaccggagatattgtcgtactgattggtggagcaaccggtcgtgacggtgtcggtggagcaaccggttccagtaaggagcataacgatacctctcttacaaaatgttccagcgaggttcagaagggaaatgcgccaatcgagcgtaagctgcaaagattgttccgtaatccgaaggcaacgaaactgatcaaaaaggcaaatgacttcggtgccggcggtgtgagtgtcgcagtaggtgaaattgcggatggattgagaattgacctggataaggttcctgtaaaatacagtggtttatccggaacagagcttgccatttctgaatcacaggaacgtatggctgttttgattgaagcggataaatttgaggaattcaagcagcttgcatatgaagagaatctggattcctgcattgtcgcagtcgttacagaggagcgccgtctggtgatgagcttccatggagaagaaatcgtaaacatctcccgtgattttctggataccaacggtgtccgcggactccaggatgtactgatccgtgagggcctgagtgataccgacccattccacagcaaagtgacctctgtggaagaaaacctgaaacagcccaatgtggcgtcccagatcggacttgcggaaatgtttgatgcttccattggaaaatcaaccgtcctcatgccatttggcggaaaatatcagttaacggaaactgaaggaagtgtacagaagctgccggtattcggctttaccaatacatgctccatcatgacacacggctatcatccggagctgtcgctatactctccgtatcttggtgccagctattctgttgttgaagcacttgcccgtgttactgccatgggtggcaactatgaaacctgccgtctgacaaatcaggagtactttgagcgactgcataccgatcctgaaaaatggggaaaaccaatgcaggcactgctggggctgattgaagcggaaatggcatttgaaactccagccatcggtggtaaggattccatgtccggaacatttaacgacatcagtgttccgccaaccttgattacctttgcggtcacaacggaaaaaacagagcatattatttcaccggagttcaaggaagccggacatcatatctattacataaagcatacaccgaacgataatcaaacaccgaattatgaagaactgaaagcaaacttcgccaaggtgcgtgagctgattcgtaaaggcgtgatttgctcagccgcaactgtgaaattcggaggacttgcggaagcactatgcaagatgagcttcggtaataaaatcggtgttgaggtgaagacaagcgaacatatctttgatctcagtatcggaagcattgttgtggagagcagtgaagcgatttacgatgaagcctttgtattacttgggaaaacgacggatgccgacacgatctgcatcaatgaggaatgcatcacaatcgataaagctatcaccgcatggtgtgagcgctacaacaccatgtatccaatgacagtggatcaggaaaagggtgttattgaaacaccggagcatactgcaaacgagcgtgttcatgcgaaaaagacgatagacaagcctaaggttattattccggtattccctggacagaactgtgaatatgatacaaaacagcagtttgagcgcgcaggtgcggaagctgaaatctatgtctttaacaatctgaatgtagaaagcattgaacgcagtttgaaggagctgagtgaaaaaattgcatcggctcagattctgatggttgtcggcggcttctccagtggggatgaaccggatggaagcggtaaatttatcgccaatgtcttaagcaatccttccgtaaacaaggctgtgcagacactgttggcaaatgatggtctgattctcggtatctgtaatggattccaggcactgatcaaatccggtctgctgccatatggagatattaccaagctgagtgaggaatcaccaactctgttcagaaacaatatcaatcgtcatgtatcccatatggcgacaacgaaaataacctccaacaaatcaccatggctgtccagctttacaccgggacagggacattccatcgcgatgtcacatggcgaaggtaaatttgtcgttagtgatgaggttgctaagcagctgtttgaaaacggacaggttgctacacagtatgtagatctggatggcaatccaacgatgaatggtacttataatatcaacggttccagctatgccattgaaggtattacttccttggatggtagaatcttcggtaagatgggacacagtgagcgttatgaagacggactgtttaaaaatattgatggggataaatatcagaatattttccagaatggcgtaaactacttcagaaataaataaaaacaaaacctatataggaataggcaaaatgcgtaaaagagaagcaattgaagcaaaacctatataggataacgcaaaatgcgtagaagaggagcaattatggatatacaatccttactgccttatatcggtggggcgatcgttattattttgcttcttctgatcgtaacaataggctatgttaaggcaccgcctgacacagcctatatcatttccggtttgaggaagaaaattatcgtgggaaaggcaagtatcaagattccgtttctggagcgtctggataagctgagtctgaagctgattccaattgatgttaaaacaagcagtatggtacctaccgctgattatatcaatattcaggtagatgccgcagtaaatgttaaggttggcagtgacagcaataagctggagcttgcagcacagaacttcctgaatcagaacagtgactacatggcacgcgttgcccgtgaggttctggagggaaatatgcgtgaaatcgtcggacgtatgcgtctggaggaaatggttagtgaccgccagaaattcgctgagctggtaaaggaaaatgcgatgccggatttagcggccatgggtctgaatatcgtcagcttcaatgttcagaatttcacagatgcaaacggggttattgacgatctgggtattgataatatttcacagatcaagaagaaagccgcaatcgcaaaggcggaagccgatcgtcaggcaaacgatgccagagttgcggcagagcgtgaaattgcaatcaagaacaatgatttgagtatccagaaggcagagctgaaaaaggttgccgatgtgaagcaggcgacagcagatgcggcttatgaaattgaaaaggaaaatcagagaaaaacgattgaggtcacctcggcggatgccaatattgcgaagcaggaacgggaagttcttctgaagtcaaaagaggcagaggttaaggaaaaggcactggaggcagaggtcaagaaacaggcggaggctgaaaaattcgcagtacagcagaaagcagatgcagagctgtatacgcgtcagaaggaagcagaagcaaagaagttcgaaattcagcaggaagcggaagcacagcgcgcaaaagcggatgcggaccgatacagccgagagcgggaagcacagggtattcagctggttggtgaagcggaggcggaagcaattcgtgcaaagggtattgccgaggcagaggctatggataaaaaagcagaggcataccagaaatataccggagctgccgtggcggaaatgctgatcaaggttcttccggatgtggcaggtaagattgctgagccgttaacacagattgataagatcaccgttatcggttccggaaatgattccagcagcattgattctgtggccggaaatgttcccggtgtcatgacgaagctatttgaatccatgaaggaaacgaccggtattgatcttggtgaaatcgtcagagcgaatacatatgatgccaaggtcacaagaaatgtgaatttctccggaatcccagccagtgataacgatacaaatgttgtggtacaggcagcggacagcgtaaggaagcaggatgaaaaaaagcctgaaaaaccggtaaagccggtagaggaaaaaccggttaaaaagaaagcggacaatgataaaatgtcctgggaaaaataaaagaagaaagcgagaacgtgtatgagtgataagtatagagaagccggagtcgatctggaagccggatatgaatccgttcgtctgattaagagtcatgtcgctagaacaaaggtaaagggagcaattgattccatcggtgcctttggcggtatgtttgatctttccgtattaaacatgaaggaaccggttctggtaagcggaaccgatggtgttggtacaaagctgcttgtggcatttgaaatggataagcatgacacagttggtattgatgctgtggcaatgtgcgtcaatgatgttctggtacagggggcagcaccgatcttcttcctggattatctggcagtaggcaaaaatgaaccgaagaaaatcgaacagctggtaaagggtgtagcggatggctgtgtgcaggcagagtgtgccctgatcggcggggaaactgccgaaatgccggatatgtatgatgtgaagcattatgatattgccggcttctgtgtgggtgccgtggataaatgcaatctgctggacggacagaaaatcaaggaaggcaatgtactgatcggtcttccaagtaccggcgtacattccaatggattctctttgatccgcaaggtattgttaaaggatgccaagctggatctgcataaggagtatgaagaaatcggaaatcagaagctgggagatgtgctgttaactccgacgaagatctatgtcaaggcaatcaagcatctgctaggcaaggttgatatcaagggaatgagtcacatcaccggaggcggcttctatgaaaatgtgcctagaatgctgaaggaaggacagggtgttaccattgatacaacagcttatcctcacaagcctatctttgatatgattgcgaaatatggaaatattccgatggatgaaatgtgcaatgtattcaacatgggtatcggctttatgatggctgtcgataaaaaagacgtggacaccgtacagagcctgttgaaggaaattcatgaggaatcctatgtcatcggtgaagttacaaatagtggaagcgtggatgtaaaatggtaaatattgcgatttttgcgagcggaaacggctccaatttcgagaatattattcaggaaataaacaacggacatgtaaacaatgcagtctgcaaggttctgattatcgataaggagcatgcctatgcgaaagagcgtgctgaaaagctgcatataccctgtgtatacgtaaatccgaaggcatatgcaggcaaggagccttacgaacagaaaattctgagtatattgaaggagcatcaggtggagctgattgttcttgccggatatatgcgttttatcggtaaggtcctgctggaaagctttccaagacgcatcatcaatctgcatccggcatatcttcccaatttcccgggagcccacagtattcaggatgcgtatgaggcaaaggtcgatttcacaggggttaccgttcattttgtagatgaaggtgtggatacgggcgaaatcatccatcaggaaaagattacgatcgattccacctggtcactggaaaccctggaagagcatgtgcatgccctggagtatgacatgtttccaaaagtaataaagcatgtatgtaaaatgatagaaagcgaggaagcataatgaagcgagcattagtcagtgtttctgataaaacaaatctggttccgtttgtatctagtctggtagagctgggatatgaaatcatctctaccggtggtacaaaaaaagcgctggaagctgcaggtatcaagacaatcggaatttccgaggtaacggattttccggaaatcatggatgggcgtgtaaaaacactgcatccaaaggttcacggggcattgctttgtgtgagggataaccctgatcatgtacgacagattgaagagctgggaatccagtatatcgatctggtatgtgtgaatctgtatccattcaaggaaaccgtgcagaagccgggtgtcagtcatgaggaaatcattgagaatatcgatatcggcggtccaagcatgctgcgcagtgcttcaaaaaattataagtttattccggttctctgtgatccgtcagattatgatgctgtagtaaaggagctgcgtgaaaacggggaaacttctcttacaacaagagaataccttgcagcgaaggtattccgtcataccgcaagctatgacacgatgattgcaagctatctgacagaaagaacaggcgagaaatatccggagaagtttaccatcacctttgacaaggtacaggagcttcgctacggagaaaacccgcatcagagtgctgctttctataagggaatgaatccacagtattctctggcaaatgcaaagcagctccatggcaaggagctttcctataataatatacaggacggaaatgcagcgattgaaattttgaaggactttgaagggcagccggcagttgtcggcttgaagcatatgaatccttgcggtgtcggtattggaaaaacgattgaggaagcatgggataaggcgtatgaggccgatccggtttctatcttcggtggtattgttgccttcaatgaaccgattcatgcgtcagtggcagaaaagctgtctaaaatcttccttgaaattattatcgcacctgcatttgatgaagatgcatttgaaattttgtccaagaagaagaatatccgtctgatgcagctggatacctcattggaggtaaatgccaaatacaaggttaccaatgtaaatgacggtctgcttgtgcaggatattgatgatcataaaattacagcagaggatcttcgctgtgtgacaaaccgcaaaccaacggaggaagagctggaacagctgttgttcgcatggaaggtggttaagcatgtcaaatccaatgccattgttcttgtaaaggacaatatgacgattggtgtcggtgccggtcagatgaaccgtgtcggtgctgcgaagattgccattgaacaggcaggagaaaaagcaaaaggctcaatcatgagctccgatgcgttcttcccgatgccggataccgttgaggaggctgtaaaagcaggcgttactgctatcattcagcctggtggttccattaaggatcagctatccattgacgtatgcaatgagcatggaattgcgatggtttatacaggagtacgacactttaagcattaatttataaaaagaggcttagcaaaacagattctttccacgtacagaaaaaagaattcaacagccgtatgctataaacggattgaattcttagcttctataagagtgtatgaatttgtgatgcagcttctttttttctgcccgcagcttttgactctgtgagatatctgtatttcacaattttcaaaagactgtgatccatggttttaaaggttttatgaatgagataggcagaaactgacaatatgcaacaagcggctggatgaaagaataataacgtggtctggtctgtggataaggggggatttaatgtgcttatcgtgagaatacataacagtgataagaaaatttctccaccaaggcagatcagtattttataggtgcctgcctgtttcagaaaaaactttttataactatgatatgataaaagcaggaacaggagcagcgctgcaggatagctgtcaataatgatcaggacatcaaatacaaatgcagcaatccatgctgcataggggattgcgaatattttaccttgcacagacagacctcctcatatatttatttctttacagctggtcgataaggatccagcagagctcgtaaatccttaccactttcatttagttcatccattgtgatatcttctttgatcattccatcatctaggacaacacagcggtcaatcacagcttcaatctcttctatgttatgcgtggaaatcaaaatgatgacatcttctttcacctgctcgatcaattgtctgacagtatcctccttggcatagatatccagtgtggtaaacggttcatccagaataatgagctttgcgttcattgcaaatccagcactgatttccacctttagctgctgacccttggaaagcgtgcgtatagtatctgttttgcttacctcaaattgatcgagtaattcaaaatagcgttctttggagaaagcaggataatacagagatagaaaatctccgtattcctttgaagacatataggggaaataactgccatcctctgtaatgaaggcaaccttgtcaaactgctcctctacggatttatcattccatgtaatgattccatcatccagaggcagaaggtttagaatacctttcagcaatgtagtcttaccgctgccgtttcttcccagaatgcctgtaatctcaccttcctgaaaatcaatagtggtattgcgcagaccccggttattggagtacagcttttttacgttttccagcttcagcatttgtaacctcccggctgtttataatcacagcattttttaagttgtatgataaatattgcactgtacaataaggaaataaacagcatgagtagatatgatttccatgaggtgtagctcagatacatcaacagcagatagctcggatacagccaaccactcatgcaggatatttctgatcggcacgcatatatcacagaggtgccgcctgtaacaacagatacataaaaactgattagaaacagtatagatgtaacagatgtaggatataagaaggggaaagcaagctgcatggagagcattgttgtaaatgattgatatttctcagggagaaacagatgctgattttccagcagctgtaagtgatattgaaatccaaaatataaaattgttagactaatcagataaaagacaagcaataggatggccaacaggagagcatctgcgacaatgcgcggcttttgtgtataagccagcagcatccatcgcgtcttgccctgacggtaatcaaacagtgtccgcaggatatagtagaaaaatataagtacaaagaaacaaaccgtaacaccataaaagaggttatagactaacggcaatagctcaatccatgaatcgctgctgtatagcaaacggatatttgatgcgatactctgcatgatgaaggcagagaccatgaaataggcgagaatggttatcagcagaattctccaaaggcggcgtatatgttgtataaattcacgtttcagcatgctccttcacctcctgaatttaactggaaaacagtccgcgggcagttctgtaagagaaggctttagttttaagaaatccagagaaccgacatacagggtcttaccgttttctataacaaggaccttgttcataaagtattcagcatctgcgttcatagaaacataaattctgccattcttatataaaatatcataaatgctgacatactcctgattagcgctatctgaaagaagctgcttgtttttaacactgatgagctgcatggtatccgtattcaatgtctgaatagtatcatcatagctgaagcaaagatagttgtcattcttataaatggtatcaaaataatggaagtcctttatgctgatttcatccttcaaattaccgttaagatcatactttgtaatatacagcttttgatttttttcgctgaatacgaacatatggtctgatgaaatctgcaatgcaagataatttcggtccatgcttacgtttgtcagcttttctgtcttcagagatgtgctcatagcgtaatagccgtgctccgtatctgtattaatgctatagctttcaggatatttcattttttttgcacgatagatataattctgaccgctcatcgccgtggtactcggtggaagaatataataatacccattatgataaacaggctgcgtggtaccaccggattctgccatgttttccggctcgatccatccgggagttaactttttatcctccgcatcatacataccgtcttctagaaggatatgcttttgatctgcgatataagacaattcggtttttataaagccaagatcattccccagctgttgagtatctgccagcattacggatacatacagggatgctttattcagcttccgtttataggaggttacatctgtctgattttgatccttttccttctcccagccactgatcgccttacagtcatcctcacatacatacgtgaaggatgtataggaggagcccggataaatctgtggttttgtaatcttatgagactctctggcacgctcatcataggatatcaaaatggatgcctcctccagatttacggtaccatcaaagctgacaccatgcagtgcggaggcatttcctattacatcctgtaaaggaaaggctgcctgtctggcaattataagaggcagactcaaacataaaatggaaacaagagctatgaaaatcataaaattcgttgtctttttcatttcatcaccctccttttccacatgaagaaagccttcaattgtattgcatgtatagggagaagcagcagcatagcagcaactgcgtaccagtcctcaatcacctgaaaatccggcatcatttgtgccagaatcaacttaataaagaggaaaataatcagaagaccaacatacagcaggactgtttgtaatcctttatatgtttccataccgattaacaaaagggtactgatacaggttagcgtgatcagctttaataaatcaagaagaatgacagctgtagtaaagggcatataggtagttgcggttgcctgagaaagctgaaaaaacagaaaggtgttgcttaggaacggctgtttatctgccataaggaagtaaagagcagtccatgtcagaaaatgcgtgcaaagcaaaccaagataggtcatgaattgaaacagcagttcactgtaaagaaaagtggatttccggattggcagaagacgaacccgggttaagcctccttcactcataaaggttttatagcgcttcctgtgtatcagaaacaggagcagaaagcttggatagaatgccagaagcataatagagttgatatcctcagtaattccgataaagcatagcgcgacctgaacgaggaagatatccacgtacaggaatatgatcttattcacataaggcgcagaggtattttcaataaataagcgaatctctttcatcgcagtctcctttctgtattgcgcacgcaatacacttgatggaaataaaaattacgtgttccatagctttgtaagccagacaatcgtctgctgaaaatccaggccgcttgtctgacactcctttacaaattccttcatcgtttcctctatcatttcactgcgcagcttttccagaattttctcattgacgataactacacttttcacattgcttatcgtctttataataccttcatcttccagctgtttataggctttttgtaccgtgttaggattgatggagagctgaagtgcaagctcacggcggcttggcagctcttcataatgcttcagctcatccgcaaggattagctttttgatatagcgactgagctgtggatacattggttctttcttgttaaactgtatatcctgtaagttcatgcacattcacctctcttcaagtgtattataaccgcaatacactgcacagtcaagaaaagcctgtttgtttttacagacaggcagactgtaaatgcattcaaaagatagtttcctcagcattaagaacaccggtttttatccattctgatagatactcgcgaatcagatgctcgtgtgtgtttttatcattggacacataattcgcaaggaatgtagcgagtgtaacatgctccgtacgaaaggctctgcttttatcctttgttgtgttctgaatccagaaaatataattgtatgctttataccagggggaaacatatacgtttatatgatattgaacatttgaacgcatatcgatgtaggcatgaaaaataggctgctcagatacaatcatatgcttatagttctcgaattcttccttttgcatcatactgtcctcctttcttttcatcacagaggttagaaagcatttgacagcggaacagctgcggatggactgacctctgtacttaatcataaagaatattatgaaaaaaacaagctttctgggacaagcggtattctacagggtggaaacggtcattttatgctgttaaaatgaaaactctatgagttctttagctttcagaaaatacagcattgcaattccctttgaaccgtggtaacattttatcgtgataaaaaaggggagctggaaacggctgagaggaagcgctcgcttcgacccataacctgattcggataatgccgacgtagggaactgtgtacaatatgagtgactgcatattgagatatggcctgcgtttgctgtatctcttttttattgctgcatacggaaggggagctccaaccgtacaaagaacttcagcgagggagcctgccagacaggctgagaggaagctgtatggcttcgaccgatcttgggatatcaaccgggaaagctgttttctttgtgcttcctgttcttatccctaaggaaagcaaacaggaggtaagtagaaatgaaaaatgagaatcgtgttttccgccatgtatttctggcaatgatggtagccgttggagttgtcatatcgccaattctgcgtgtggagggaatgtgcccgatggcacactttatcaatattacagtggcagtgttgatgggaccctggtattcgtttctgtgtgcggtactgatcggggtaattcgtatggcagtcatggggattccgccgctagcattaacaggagctgtatttggtgcagcattgtcaggtatcttttataaaatcagcaagggaaacatatgggcagctgtgctgggggagattatcggaacaggaatcatcggggcgattgtttcctttccggtcatggcgttgctatggggaagaaacggtctgacctggatgttctacgttcctagcttctttatgggaacagttatcggcggtagtattgcattcgtatttctgacatccatgcagcacagcggtatgctgcttaagatgcagagaaagctgggaggagaacagaatgtacgagaaactctggagtctgagaaaacagctgcagcacagtcataatctgattcactgcatcaccaatccaatcagtatgaacgattgtgcaaatgctgtactggcactgggagcgaagccgattatggcacagcatccgatggaatgtgaacagataaccgcatgcagtaaggcactggcactgaatcttggtaactttgatgacagtcgtgcgattgctatgaagaaaagtcttcattgtgcaaatgagaacggtattccggtaattgttgacatggttggtgctggctgcagtgacctgcgtgaagcgtttgcagagaagctgttgcatgaaggaaaattctccatcataaaaggtaatctttccgagctgaaggcagttagtggccgtgacagtcatgctctggggattgatgtgggtgatgatgatcgggaagctcctgcaaagagtgctgaatggctggccgagcttgcacgcaaatatggtactactgtcttgtgcagtggagaggtggacattctaacggatggaaagcagatatattttgtagagaacggggattccatgatgacgctttgtacaggaacaggctgtatgctgaatgtgattgcagcagcatttttatccgttacagagactgcgcttgatgcagcattggcagcatgtataacctttgagctggctgcggagaaaagtgtttcaatcacagagggaccgggcagctttcatgcatcactgtttgattctttatatgaaataaatacgctggattttgcgaaagcaaggattaggagagagctatgagatttgatttaacattatatctggtaagtgattcaacaggtttatcagaagatgagtttcttagacgacttgaacaggcgttacgcggcggtgttactctattgcagttaagagaaaaaaacagaacaacgctggaatactatgagcttgcccgcaaagtaaaaaagctgacggatgcttatggggtaccgcttatgattgacgatcgtgtggatatcgctcttgcagtggatgcggctggcgtccatgtcggtgcagaggatatgccagtcagagaagcacgcagactcatggggccggataaaattgtaggtgcaacagcgaagcgtgtggatactgccatgcaggcagaagcagatggtgctgattatctgggagtcggcgcaatttatccgactacgacaaaggtgaagactgtattaaccagcgtggaaacactgcaggatatctgtgcacatgtttcgattccggttggtgctatcggtggcttgaatgcagagaattgtgagattctaaagggaacgggtattaagggaatctgtgttgtatctgccattatgaagcaggaaaattcctatgatgcagcgaaagcattaaaagctaaaatcatgacaatctgtaaatagcattgtggataagataagaaaaagacaacttctaaggggttaaaagctcttaaaagatgtcttttttatgaagcttcctacagcctttcaactgttattgcagatgcttcagataattcatactgtgtagtattcaaccttacctttctgttaacgtgtaatccgatataatatgaggcacattctagttagctgcttccgtagttctctatatcatagctgttatctattgttattcatatgaaaatatagtaacaggatatccaaaaaagcagctgtaaaaatcccatgtatataaaatgtgcatagatacttttatttgataaatatcgtttcgttaaattcaaaatgatgagtggtgctatcgaagttaataacaacaacagcaaatagagaaaaacaggcagtttcgttagcaggttaacaaagcttactatgatacatgaatttgtaagaactaaatatatcttatgaaaaccgatcgttgaatttaatttcaatcttgaaaatgcagaggcatataccggtatcttaaagagaagtggaagaaacataaggaattgaaatattgattctaattctccttctacaaatttcatataaaatcctatcctttatattgctaaaacgatcagatcaggagtctttggaaagtgtcagattgttatcagaaatataatctttaatttttccgtaaaacttaaaggtatgatatagccttgtatcttgaatgaaggcttctgtaacatctttattttcctcatttactactctataggatttatctccttcataaatagggttgataaatcttttcagatcatcgaattccggattcataatgtacattatataaccaaagcacaaaatgcatacaatcgccagacatacatgccattttttcagcttcatacagcatcctccttatttgtttttttgtacaagtaaagcatttgtaaattcatcctgttattgtaagtttcagaaatagcaaggtgtgtaaattctttatcatacacgcatctctgtatcactttcatactatatccttacctatggaatgaccagtatttggtattgaatggcataatagcgggaatcaatggttaacagaatatgataaaacagttaattcgtatgtatgcccgctatgcaaccatccttcatggtatagacagtatcgcagcgttttgccaattccatattatgagtcacaaatacaattgccttctcctgctttcttaaatctaagagtatctgaaaaacgcgttcagaattttcggcatcaagcgctcctgtgggttcatccgccagcaatatcgacggattattgactagcgctcttgcgattgcagtcctttggcgttcaccacctgaaaaatcatgggcttttttctttaaaagctgctgtattcccagtgcttcgctcaaagatgatagtatcgtttgctgcttcgtctccgggattttcttcttactatatacgaatggcaatgcaatattttccatcactgtgtcctgttccattaacgcatattcctgaaatatatatccgaagctttcattgcgtattgccggaagatcttttccttctttcacctcctgtccgtttatgatgatttttccctcatccggcttcatgagcagaccgagcatgtgaagcagggttgatttcccgcatccgctgggaccgcaaattgcagttattttatgcggacagatatccatgctcacatgattaactgctgtaattgcctgttttccctgatgaaatctttttgttaaatcttcacaatgtatgagtgccataaaattccttcctttcagttatcgcgtatttcaataagtaagtgttcaagctcgatggagcggatgctaaaataacaaatacctccctgaacgagcaggagaataacagcagttattagaatcagtgcaaaggacagaccttgtgcactgaaggtaaaaagcagaaggaaaggaaggccgaataggaatgttatgtaccaataaagccgaagccatatatcctttctgcaagcaccgtatatcaggtgaattgtatattcttttctattatttcgaatcaatagcttcaatatataaaagagaaagattatgcagagtataaacatggcagcataataaagcagaaaatacaggttctcctgataagtactttgatagagacggcttttaaccagattattttgcggaaccatggttctggattcaggaagagaagtaagtaattgatttatttctgcattctgattttttgtaatcgtcaggtgatccagtatttccatgtcatagctgctatccattgtgtgaaaggaattaaaatcacagatcagaaccagctcgttgtccagggatatcctacccataccattatccagatagctgcttccttttttcagcttgtcgattaccggtatttcttttccatggaaggggtagcctgtctgatctgattgcttgtcattaccaacaagtatgccgatcgcgtttatatcttttccagtaagttgaaagaaagccggaaaggaaccaaagactataaaatattcatttccatcttcatcaaagtaatcggatatataagaatatgcgttcccgttgtatcgaagagctgtggaaagatactgcagagtatccctgttgctttcactatcatctacctgaaaagaggaaaactgcaccggtgccgctttctgtatatgattgaaaaactgatactcacgatagctgattgaaatctgagtgctgaagataccgcagcatgtcgcaatcataattacaaacagtgccgtagtgaaggagcgcagcttatgatatttgatatcctttaatgcaaagtgaatttgcttattcataaaggtagccctccttgttgaggttcctgaaaaggatgagtatacacgccgctgttagaaatagtaaggaaattagcattgcaaacaggttgatccagatgctttcacggataaaagtcagctgtagctgttgtataatccaatgatgaaataaaagagcagggatacagccaataaagccaagaaagaatatttcacgcagattttctaataataatgcttttctggacgctcccagcgcctgttttataaaatattctcttttcttacatgcaatggaatggtaaatgaaatagctgagaccaatgaaaacaaatacataggaaaacagcatataggaaaaaaatggattgttgatgatgccggataatttactccaattggaaaaggtctcttcagtgtattcataatgatgtatatccagattctgtcgtataatatttaacagctcatccgaacccttgacaatgagatttccctgaagcttggaataggagaatagattatatataagataatggtcaccggggatttccttcaccgctccaagaacagtgcctgtttctattttatataattgaggatgctcaaacaaatatgaagttttcaggatataggaataacgctcatcagtagaaaggctgtttgcttgaaacgtagtttcaggaagtccatacgcatttattagcttatgcgatgggtcatacaatcctaaaccaatatcatcaacattatcaagaatcagtatatcggtatcctcattcagcgtttctctaatagaagcatacaactgcttccctgaaagtggatgtgtggtatctgtttcacggatttgcagaagcttgtagcctgagcgtatctgatatatgtcatccagctcaccattcctgcatgtgatcagagataaaaacatgataacggtaaacatgagcagaaaagatatacagatatatacaaatctagttgctcccataaggtctcatcaaagctgtgttttttattagggctgattttttcattacagttatttcctttttgatagcatatatattgcaatattacctaatataaggatcagcgcatttaaattaaaagcaatagaggatgttattgtgtgacaatcatataaataacgtattgtaaatagtgagataagacctaatgctataatcatcaatataatatataaatttttcatatcaagcccttgttaccctatattcccagtaaccactattgcatggccctgaataactaggctcacagccaggtatttttccaggtatgaatcttccagttaattcatatttaacaagattttttttcttagtgcctaaatatctcagtgctattctacatgcatctgttccagttacataatatactgcagaacaaacccctactgcattccatataaccttggcaatcgtgatccatgcgatacgtgtttttccggtgcttttaatatcaaaggtattatcataattatgaccgtagtctcggataattatagcatcattttccagataagtaacttcgacattctcttcaaacattttcacctcattaccgctttcatctacccattcattgattacttttgaaggcgctactgtgcaatcggagcaaggttctgcgccataaattttaaatgcatttgaatttaatgcaacatttattaacaaagctgataataacaaataacatatgatctttttcataatatactcctttcccacttgaaaattaaacaaacgtttgtatatacatatattactgcttcaacgtatgaaatcaataactttgtcatctaaaagcattccttgtcatctaaggggatgaaatatcacgttgacaaatcaaatatgtatagtaatatgtagatgataagggatatgaaggggagtgtagcatatggggaaaagaaaactgttattatgtgatgatgaattgtcatatgctgaagatattaagaaaatgatcgatgatttatatcctgttctatatgaaattcagacagaaacagatcaaagctttaatattgatgcacaatttgatatttattttttggatatagatatgcctagtatctcaggttttgatttagcagagaaaattcataatcgttatcctgaggcattaattgtatttttgactacacatgaagagctttccatggaaggctaccaatatcaggcatttcgatttataagtaaattacgtcttgatagtatgctccccagagtattaaaagcgttaaaagagtattttgaacaatatgaccagatgatatatgtaaaagatgaaaatgatgccactgtgccattactgattaaagatatcacctgtttattggcaaaaggtaattatacggatttcaatacagaaaaaaatgtgtttagtaaaagaatcaaagtgaaggagtttttgaatagctataagacagaggttttcatacctatagaaagaggtctatgggtaaacatgcgacatgtaaaaaaatatgacccaaaaacaggagtattatttatacaggaaggtgtacacctaacagtaacaagaaaatataaagcagaatttttaaaacaatacataaaaagaggcactttttgtacttagatgacaaaaagtgtttttaaatgacaaatatattgtggtctttttaataaataattatgctatagaagaaagacgagggagtgtttatatgatgaagaagctgttaatggtattgttttgttttccaatactttgcaatatcaatgtatttgcatcagagtatgtgcaagatgaattactggaagaggatttagatttgacagaagaaattgaaatgtttgattccttttatcaacagccggaccgctatatttttcaggatatcaatggtgatgatttaaacggttttgttatgcagtataaggatgaattctataagaatcaatatcagaccactgatttccttatggaatatgttagaagtgtacaggacttaggaagtgttatttcatactattcaggaagatcaaaaacatgggctaatcagaaggtctattatacaaagaccagatacaatgtttatagtgctactggtagttgtacagtgaccaataataaaattacatcagggaaatgcagcgctaaaatagtttcaaagaataacacgtatagtattttaaggacttcttgttctataagcgagcagggaaagaaaatcacttttacgattactcataatattaataataaaataattacgacaaagcatactatcaccatatagttaaatcatgttataatggcagtggtgatagtcatggaatatattgatgcattactaattatgcatatgctaagatccatatgttcttatttctttttatacaagataatggaattaaagacataccataaatcaaggatagaaacctatttattccttttttttcttataattgtatttataggaaatctagctatttttgcttttatttcatgggaagataagtttggtatagttagatactatccggatattatagaagatattctcatgatgttggttattatagctgtttttcatacgaatatatggaaaagcatatactattcggtttttggctatatgtttgtaatgtcagtgcagcttttgggatcaattattgattttattatctttcaatatatttttcacatcatattgactactgatcaagaagcaatcctttatatattagaaattggtatgctatttattttctatatgattattggacacaagaataaaatacaatatgagatagatgaaaaagactggcctttatttgccgtactggcaattattgtatgtgcatatttctattatatccagaatgttgtgccatatatcgatccggaaaacagtatcatgtatgtatccatggattacattcaacttggttttatggttgggatattctttctgtttggcagatatcatatcatcttggggaaaaagagtcaggagcttctaaatacacagttgaagctgcaaagtgaagaatttcagttgaaattaagagatgagcttacacatgcgaatacagagaacaaaaagcttcgtcatgaccttaagcatcactttacggtacttcagagtaaaattaaagaagatcctgaatatgcattggaatatgttaaacagctaagtgaccatgtggaaattgtaacgtatgcaaatacaaacaatgaaatcctgaactatattctgaatacaaaggccgcaatagcacatcaaatggacataccatttgaatataaaataagtgatgctctcttatttattaatgattttgatttaatatccatattgggaaatgcattggataatgcaatcgaggcactgcagtttgtgaaggaagcatggattcatatggtaattgcgagctatgaagacacggtcattattaagattgaaaatccatgcgactctgtaagaataaaatggaatgatgatgtattatcaacatcaaaaaaagataaagataagcacggatacggactgaaaaatataaaagagctatgcgagaaatatcagggctctatggaaatcaatatagaaaatgctatatttcagctgatactgtcatttcttaaaatatagaggtgtctaggaaggacaccttttataatgtttgtttaaatgacaaaacttgtgcttagataccaaaacagtagttaaaataacgtttttttgttattatgcacttggggtggtactatgcaaaatcaggaagttatgaaagaagaatctgttggctttcttttaattcaatataagtatgttcttgaatatctgcagcttttagctgaagataattggagattaaaaaaggtaaaagatacttctttttattttgaaagaggatatagagtacagcattcctactgtttgattccggttgacatgtttgacagagagcttgaactgagggcaaagcaattggattggaaacgaataggtgcatggaagcatcttcttgtttttggaaatgaaacactgaatgcaattcctttgatagaagagcgtatcctgaatgaatacataaaagcaagcagatataaatgggaagactttgttcgtatagtatgctatattattggttctataagctgttttttatcctcgttttggtgtgtgtttcattcaactgatttcatttcatttttctttctcagtttgttatggtgtggtgtatctgtttttcaattttgggtcttgattcgcgcaagcaggtgtatatggaggtttgattttgagacagtaaaggatatcgaaaaggctaaaaaaacgatattgggaataaatgaaaatatgattattagtattattgcttcaattcttatacttatagtcggctaagcttcccctaaattcaggcattttaatttctttttcatctatattcatccataatataagcagcattgacaaaagtgaatgattttctataggaatttacgccaatctgttttataatcataacgtcagggatgaatgtaatagaaaaggaggagcttatgctgaacaaggaaaaaatatatatcaccggtcacaggcatccggatacggattccatcgcatccgccatcgcctatgcaaaactcaagcagcgtcagggctttcatgctattgcctgccgccttggtccggtgaatgcggaaactgaatatttgcttgaacgcttccacatggatttgcctatgctgttcgaggatgcgcgcgccactctggatgaaattgaaattgacggcccgctggcaatcagtccgcagacaaccattatggaaacactggagctgatgagtgaacaaaacaagcagtcctacggtgttatcaatgcacagggaaaactaatggggatggttaccaaatcagacctcgctacggttggtctgggagatactgctgtcgctattcagcttctgcaggagactccgccggaatatatcgcgaaaacggtgagcgggaaaatgatatacatggataaagcgtatcattttaacggaaagacaagcgtcattgcgattgcggaaacaaagcttaacaactatgaactgcaggaccgtcttgtcattgtagggaatgactcggaagcacaggaagcagcaattcgcaagggagcgggaatcctggttgcggtatggacggagcatattgaagaaagcgtgattgcacttgcgaaggaatatcactgtcccatcatcctctctgggcatggaacaatgaatacctcccgttatctgttcttttctccgccggtcaagctgcttatgaaaaccgatctcgtcagctttaataaaaatgaatttgttgatgaggtgggaaagaaaatgctgaaatcaagataccgcagctatccggtgattgatgatgaaaaccatctgatcggctatgtttcacgctatcacattttgaatcagcataacaagaaggttattctggtggatcacaatgaatatgcacaatcggtgaaaagtatagaaaaggctgacttactggaggttgtggatcatcaccgtgtatgtgatatttccactaaccggccaatttccttccgtaatgaaatcataggaagtacggcatccatcataacatccatatatctggaaaatcagatgagtataccgaaggatattgccggtctgctgcttggcgcaatactctccgatacgctgaaattcaaatcaccgacaacaaccgcaaaggataagggacttgccagaatgctggcagaaattgcggagctggatatcgatgtatttgcgaaagagatgttcaaggtaagctccaatatcagtaacaagacaccgcgtgagctgctgaatcaggacatcaaaaaatttgaaatcgacggcagaactgtcatgatctcacaggtgattgcctatcaggtaagtgaagccaaggaaatcgaggatactctgcaaagcgaaatggtgaaatttgcacaggaaaaaggacttgatcttctggttgttgcatttacgagtatactggagaacggctctgtcttctatgctgccggtgatattgcggatgtggtcgctgaggcgtttccaaaccactttgaagaagagcatagctttcaggaggatatattatccagaaaaaatcagattgtgccattgctttcccgggcaatcatcaattctgtacactgattttcaaaaaagacaatcccagagaagattgtcttttttacagtgtgtcaggcatggatatatctaacccgtgagaacaaggatgaaagtgcaagcctacaaaagacagaaaaaacggttatatactataattaaaaaggctttcaaaagaaaacatgccggttccgaaccattagtaaaggcattacaagagtaaatcaggttgtgcggggatggataaactatttcaaaacaggacatgaaaatataccttagtaagtttggacaatggttacgccataagataagatgtgtcatcataaacaatggaagaaatcaaaacgatttttaagaatccaatgaaattaaatattgcatgtaagagtaaatttagaaaagaagatatctacaaatgtgcaatcacagaattaggatggtatagaagaagtacgatgaaggtcgtaaatttcacatgatcttcaaaaattctaggcattaagaaaggggacagacctgacctggtgcatcccctggattcttaagagtttgtaataccgatataaatgtaggaccgtatacgtgacctgtacgtatagttcaatggtataaatttaagtttattcctctaccctattccgcagattgtttattttgcgctttctatatagtcctttacattttcttcaacaacatggaatggtgctgcaccgcttttcagaattgcttcatggaagtccctgtcattgaatttatcctttagttcctcctgtgcatccttcttcagattggcaatctggacatatcctacataataagagaggaatgctgttggatttgcctgcagctggttatagaaatcactgacatcggaaacgccaagaccgttttcctccaggaaatttgataaatcttcctttgtccatccttcatagtgaataccgatatcggcaagagctatcaggcaatcctgatagacaaccatattctgctgcagcttgacagcatccgcagatacaccgtcaagatactttaatgcatacagctcggtatatgtggcatagccctcggtataaccaaggaagcttgccatactgtttctccatgggtcttttacattcttataggcatatgcaatctgatacatatgtcccggaattccctcgtgtgcaacggtagagaaggtttccagtgactgtacattcagtgcatcctccaacatattcacacgaatctgtttcggtgtggtaccgtccagtgcaggaatgttgaagtaagccgcaacaccgccggatgccagatcctcaccgatcggcctgattcgataattcagtgttcccacggatggaaagtcatccttaatatccttatcaagatccttcagcatgctttcaaagtccttgtacttagttttgatttttccgtttacatattcatcatacagattcttgtttttggagatcacagactgtacggcaagcagggatgaacgcgacatactgtttaattcttttttaatatcctcgatggatttatccgtgccggttgcctgcttgaacagaagctcataatactcttttccgttcttcatatggctcagtcccagcgtattgtttttagaggaatccagctccttcatcgttttgatgatatcactgtacgcaggcaggaaatactcctgaaatgcttttttcagctcagccttgtactgctttgtcttatcatccccaagcttcagattgtcgatactttcattcagcccggtaagtacactgctgtttacatcctccttaacaaccttctcgcaatactcttttacagatttgatatccagcatcagtgtgcctttttcttcctgctttttcgtataggcaagaatactgtccatatacggacggactgatttcatcagtgtgataacatcctttacatcctgctcattgcgaagtgtccagtcggagaacagggttggcagctgtgtgtgcatacctgtcatggattccagtggcatactcatataatcaaacttggaatcgttcatttctgtagtgtaatccagcatgtagctgtaaatatcataagtttccttctgctcatcgcttaacgtatcgcggtcaaattccttgaaggccttcgcggatttctcattcagctccttgttttccttcatggttgtttcattcagttctttatcgatctgaaccttggtcttgcttgtatctactccgtaatcctttgggttttccagaataatgtgcgtattcggatagctttgttccatagattccacgaattcctgcttcataaattcatcaaacttcttctgttcttctccggaatccttttttgagcatccggtgaatgaaaaagccatgactgcagataacatcaataatgttattttctttacgttcatatttcctccattttctctctgtttctaagtagagtgtgtttgtactacagatattttatgtatcttactgttattatatcgtctaatcattgatttcacaatgaattatccacggaaacgggttttgttatgaatcaagttgtcgagtagaaaggtttatgatattctaatatagaaaagagttgatgattgtgcatgaacgacatacaaaaatactggagcttctctctcaatataaaaaaatagaggtaaccagattatctgagctgctttctgtttcacaggtgacgattcgcaaggatctcatgcagctggaaagcagtggtctgattctgcgggagcatggatatgcggctttgcatgacagtgatgatctggcaaaccggctcgtctatcattatgaaatcaagcagagaattgccagtctggcggtggcggatgttcaggatggggagacgcttatgattgaatccggttcgtgctgtgcactggtcgctctggaaatcgcaaaaacaaaaaagaatgtgaccgtgatcaccaattccgcttttattgctgattatatacgtaagcagggaactctgcaaatcattttgctgggaggcgaataccagcagagctcgcaggtcatggttggaccgatgacgagaagatgcatggagccgttttatgtagataagctgtttatcggtaccgatggattcacagcggattcaggttttacgggaaatgattatatgcgcagtgaaacggtacgtgatatggctcaacaggcaaatcatgtcattgtagttacagaatccactaagttttcacagaagggacttgttcatctgatagataccggtcatattcatatggttgtcagcgatgatcgtataccggaggaatgcgagcagtacctcacggagcaaggtgtggaagtaaaaaaagtgaaggtataaaaaaaggagcatctgcccctaaaagaaacaatcaataccctgattcaggaagatttgctgataatctcttaaatcttccggatacagggcttttttatgcttcatttcatagtcgcgattcagcatttcatatttcttttcgccgaactgatgaaagggaaggagctgtacccgttgaattgagagtgatgtaagcagtgcagcaaggccttttgcatcctgcagggatgcattatatcccgggatgatgggtatgcgtggaagaacacagagctgatgtttcacactccatgcaaggttttccagtatcagatcattgttgacgccggtcccaagaacgtgctgttctgtgtcataatgcttgatatcgaacagtaaaagatcaaacagcggggcaagcttttgaaatacagcgggctggatatatccggtagtttcaactgcgacatggattccctcctgcttcaggcgtaaaacaagtgcctttgcaaatgacggctgtgccagagcttctccgccggaaagtgtaacaccaccctgagattcttcataaaagtcgcggtcctgcaggcaggttgcgacaacctcatcagcatccctgcagacgccttccacctgcagggcttttgctttacacgtagcgatgcagcgaagacagccaagacattgtgcatcgttgatcacaatacggctgccctttctttgaactgcctgctgcggacatgcctgtatacatgcgccatcctgtatacaaacagatgcatcatataatatctgtgtctttgaaagctgagactccggattggaacaccagcggcagcgaagcggacagcctttcagaaaaacggttgtccgaataccgggaccgtcgtgtatgctgaatttctggatattgaataccatacctttacacattaacatcactccttactaccgttatcatagcacaggagtgataaattgtaaaataaatatttcaaatgaaattaatgttgtattcaaatgaaatattcatcttgacttaactcaacgatatgatactataatagtgtattgtttgaatttatatttcatatgaaactaaaaacaagcgtggaggaaagcatatggaaaacagagaacactttggaacactcacagaaagaatgcatagcttcagagaggagcttctgaatacagaggcatccattgacgccacacgtgctgtgcttgcgacacaggcatatcaggagcatgcggataagccgctgcttgtaaagcgtgctttcatgctgaaaaatattttggagaatatgccgatctttatcgagccgcagacactgctcgctggtaatcaggctaagaaaaaccgggcagcacctatcttcccggaatatgcgatggattgggttataaaagagctggatgaattcgagcttcgtgacggggatgtttttcaaatcgatgaagagacaaaggaagaactagaaagcatcgctccttactggtatcataatacaacactggataaaggacttgccatgattccaccggaaagcagaatcttttatgatctcggtattatcaaagcggaaggaaatatcacaagcggggatgcacatatcgctgttgactatggaaaaattatgcgaaaagggctcaggtattatgagcagcgaaccttgcaggagaaaaggaagctggatatgacagaaccggatagcatttccaaatatcatttttatgaggcgattctgatcgtcattgctgccgtacaggcatttgcaaagcgctatgctgagcttgcgcttgcacaggctgaagcagcacagggaaaacgaaagcaggaattacagaaaatggcgcagatactggacagggtgccgtataaaccggctgaaaattttcatgaagctatacagtccatgtggcttgtccacctcgttttacagatagaatccaatggacattctctttcctatggacgtatggatcagtatttatatccatacgtaaagcatgatttggatacgcgggtattgcaagaggaacaggccgtagagcttttaacaaatctgtggctgaaaacatttactatcaataaggtaagaagctggtcgcatacacaattcagtgccggttctcccctgtatcagaatgttacggtaggaggacagacccatgatggacaggatgctgtaaatatgctgtcctttctcatactaaaatctgttgcacagacccgtcttccacagcctaatctgactgtacgctatcatagaaatttatctgctgcgtttatggatgaagcaatcgaggtcgtaaagctgggaaccgggatgccggcttttaattccgatgaggttataattccatccttcatggaaaagggtgttggtaaagaagatgcatacaattatagcgcgattggctgcgtggaaactgcagtacccggaaaatggggttatcgctgtaccggtatgagctttctgaattttccgaaaacgctgctgatcgccatgaatgcaggtgtggatcctgccagtcaggtaaagctggtggaggggcttacacatttcagtgaaatgacatcctatgctcagctacaggaagcatgggatataacaatacgtgagttcacaagacattctgtgatcattgaaaactgctgtgatctcgttctggagcaggatgttccggatgtattatgcagtgcattgacggaggattgtatcggacggggaaaaaccataaaagaagggggagctgtatatgatttcatatccgggctgcaggtgggaatcgccaaccttgcggacagtctggcagcagtaaaaaagctggtatttgaggaacaaaaaataactgcggatcagctgtgggatgcattgatggatgattttacatcaccacagcataaagcgatacaacagatgctgattgcggatgctcccaaatatggaaatgatgatgattatgtagaccagctgattgtggatgcctatgatgtctatatcaacgaagtgaaaaaatatccgaatacgcgttatggaagaggaccgatcggaggaacacggtatgccggtacctccagtatctctgccaatgtcggtcagggaaagggaactcttgctactccggacgggcgtaatgctgccacaccgcttgctgaaggctgttccccatcacatggtatggataagaacggacctactgctgtattcaaaaccgtttccaagcttccgacacatgaaattaccggcggggtgctgttaaatcagaaaatgacgccgcagatgctgtcgagcgaggagaataagcagaagctggaaatgatgatacgtaccttctttaatcgcctggacggttaccatgttcaatataatgtggtttcccgtgatacactgcttgatgcacagaagcatccgcagaagcatcgggatctgattgtccgtgttgccggttattctgctttctttaatgtcctgtccaggcaaacacaggatgatataattgagcgtacagaacaaacgttatagtccgtgaagaaaatctgtctgcgtttataaaagaaaaagaatcgtgatgtcctgcactatacaggctcacgattcttttttaatgcttattgctatacagatgtcttgcgacataaacgccgcttgcacttgcatgtgagagggaatgggtaacaccgctgcaatcaccaatcacgtacagtccttcatgcctggtttccagattatgatcaatttcaacctccagattatagaattttacctctacaccatacagcagggtatcatcattggcagttcccggtgccaccttgtccagtgcataaatcatttcgatgatgtcatccatctggcgtttgggaattaccagactcagatcacccggtgtagcggataaggttggtgtgacaaagctttccgcgatacgggagtccgtgcttctctgtccgcgtatcaaatcaccaaagcgctgtacgataacgccgccccccagcatattggaaagacgcgcaatgctttccccatattcgttgctgtccttaaacggctctgtaaagtgattgcttaccaacagggcgaaattcgtattctctgtgtagcgggaagggtcttcatagctgtgcccgttcaccgttacaattccattggtattttcactgacgacaacaccgcggggattcatgcagaaggtacggaccttgtcctggaacttcgtcgtacggtatacgattttgctttcatacaattcatccgtcagatcggagaaaatgctgtagggcagttctacacgcacaccgatgtccacacggttgctcttcgtggcaattcccaggcttttacagatgcttcccatccatttgcttccactgcggcctgtggatataatgcatttgctgccggtaaagcttttatccctgctcaccagacgatagccgttctccagcttttccactgcatctatatgcgtatggaagtgtatttcaattttatccttcagctgattgtacaggttttccagaacaatataattcacatccgtaccaagatggcgtacgcttgcctccagcagatgtaaatcattctgcatgcatttctttttcagatgcgtattttcatttgtataaagctttgtcccctgtccaccgtttgccacattgatttcatcgacataattcatcagatcaattgcttctttccttccgatatgttcgtataaggtaccgccaaactggttggtgatattgtattttccatcagaaaaggctcctgctccgccaaacccgttcataatggcacaggtcttacagttgatgcaggatttaattttcaccccgtcaatcggacattttcttttctccagcgggtttcctgtttcgaataaagcaatcttcagctccgggttcagtttcatcgcctcgtaggcagagaagataccgccgggaccggccccgacaatcagtaaatcaaaatccatatgttacctccatcgttatatgtataacttccgggaaatcttgaatttcctatggtattttatcacagaaacagaaaaaagccagcggtattcatgaaaactttatgaaaacggttactattcactaacctatattgtatataacgcttagataagggcaaaagaaagcttatattacttatgggttttgattgaaactgcgtatcataagcatgaataactctccacacttgttatgcagagagcctttcattgtatggagatatggttaaaggtgttgctcttatacgattacttacatcgtgtcagccgtatgtacttgttttttaacagcctccagggtatcacactttaaaattaaacttgatacgatatgcaattggtcctcggttaatgactgcagccatgctgtgcagtcttcctgatatttggcttccataagcctatgtaagagctgtctctctccttcgattctaccttcaaccttaccttcagctttccctttaatgattccttccttcatcccctcttcaaagctgtcctccaagccgtagcgataacgtgcctctcccatctgaatcgccattgcggttgaccacagctcatcatccttctgcatttcctcgtacttgttcacgaataccttcaccagcctttcctttgattccagtatatcatttttcgcattgttttcaaacaggaagcacagctgttcaaagtcatccatctgctgaatggcctttttcttagcgatttcattgataacgggcagatggatgtaggttcttctaatcaatgggtgtttactctcatcttccccctgctcattgcgcatctgatagtggttgatcagatttttattattccatgcgcatttctcaatgaaaataatctgatataccggctttaaatccttgtacttttcactgctatccagctggttgttcaatgctctggccccataaaattcaaagcgcatcatttccgctactcctgcataggtcgtctgcatttccagattaaaaaaacgacctttctcatccttcacatgaacatccagaataatgcgtttcttcccgattgttccgggatccagattcggattctgtacagtgctttcctttaccttaattccggtaacacgttcaataatggtgttgcgggcgtacacagagccttcatcctcacgggaaagggtgtacttgaagaatacatcattgcagtaattcaatacagtatttgctttcgtattttccatgacgaaaacctccttctgtaagctcatcatcacttacatacttctatacgttaagaaggtatgaaattcctaaaaaatccacatattcttgattttttcctgctttaaaaggattgtcagcttgcattttacagagttgcgatttcgatcacttctatctaaatgtatataacagaaaaagatgaggcgataaaatagcttttctgcctttataaagaaacaggtataatcctgcaatcgatgtccatacttcagctatgaggtgaagaaatgaaacgttatgcaataatcggctgtctgtggtttcttatggcatctgctatgattcatggaaatgccagagcagagattgattatgaaatccgctatgacagcaatacgaagcagacctatgagctgaaacagaaaattcaggatatctattccgagctggttcgtggtgtacataaggaatcctatattctgatggtgcttcataataaggaattatttgcttaccgaaaggatcttcaggctgactggaaacagaatcagctagtgattaccgagggtgatggaaaaggagatacgattaccggtacattgcgaacagaaagtgtgtgtgttccggaggttcaaccgcgttccctttttcaggagatatttcaatagctatatttgcaaacatcaacggctttttcctgttggtgtttttttcttgcaggtgagtcacggattcctgcaacttggttgaattttatagcttttctattcatgtgcaaatataataaaaacaggaggatgcggtatgaaaatcattgagggtaaggattcacaacagctggatgtccgcatccggtttgactcgttggaggaaaaacaggcagctttccgcttgctggcagctatgcatcaaaagctgatcggcttgcaaagagataaggaatatctgctgcgtctggaggatgtctgctttatcgcttccagtgacaagcgtacctttttatatactgcacagggctgttacgagtctatgctctggctttatcagatggaagaacagctgaatgatgatttcatacggatcaacaaagcaacaattatcaatatggaacatgtaaccagcatgcatgcagacctggggtcaagaatccgggtatatctggataccggtcatcagcatatggtcacaaggacctatgtaaaggcatttaagcagaagctgaaaggggaataatggcatgtataactatctggttaaattttttagaaatgtaacaatgtccttttttactgcgatttttgtaattgcactggcaggtgtcacatgccgggatggaattatgaaggtgtcaagcttttatgtgcagggcggtatttccttttctgctgtttttgagcttttattgctttcctctcttctggcattatgcaatttgcttctggataagcccacagtatttcctgcaatgcgtctgacctacaaaattattttgcgtattgcagttgttgtgatgctgattctaccgtttatttatgtatgccgctggtttcctgttgatgatcatgcagcatggatcggctttgttgtctgctttctgttaagcttctcggcagcaactctgctaagtgtgtatgccacacgaagaaaggatcgggaatatcagaagctgctggaggcctataaggcaaagaaagaggagaggaaaaaatgacaatactggaagcggatcacatacagaagagatttgcggaaaaaatggttttaaaggatatcagcttttccattgagaagccggaaatctttggacttctgggaccgtcagggtcaggaaaaacaacgctgatacggattctacttggcttattaaagaaggacggcggcagctcatatgttctggggaatgattccgggcacctaagtgatgatacgtatgcacagattggtatgatgctggatgaagctggattatatgatcgtttatcctgtatagataatctggatatatacagaaggctctatcagcttccttataatgtcatagaaccggcactgcgccgtgtatctctgtatgacagcagacagaaagcagtcattaagctgtccaagggtatgaagcagcggctttcctttgccagagcattgcttcatgagcctagggttttatttttggatgagcctacctcgggattggatccggcaacaacatccaacattcatgagcttttgtttgagctgaaggaaaagggtgtcactatctttctgacaacacacgatatggaggaggcaacacgcctatgcgacagagtggcctttttgaatgaggggtctatcatcgaatgtgatacgccggaagctatctgctgcaaatacaatacgacgaatcaggttaacataacgacagcgcagggagagagtattgtgctggatatcaagagagatgcagtaaaaattatgcatctgatggaagccggacatgtgaagaccatccattccatggagcctacactggaaactgtatttatcacactgacaggaaaggagctggtctgatatgaagccttctcatatatatgcaatcatccgtaagcagctaaaggacacctttcgtaataagcctacgcttgtacagtttgtgatgtttccggcaatcgcagcaattctgacactttccgccggcgaatttgaactgccgaaaagatactttgtaaatctattttctgttatgtatgtatgcatggctccgattctcatcctgtctgcaatcatcagtgaggaaaaggaaaagggctctttacgtatgctcatgatgtcgaatgtaaaaccgatggaatatctgctgggcatcggagcgtatgtgtttgtattttgtatggcaggtgtgctgtttatgggattactggggaaattctccctgcaggagctgtggatgtttctgctgctgaatgcatgcggtattctgatttcctcagttattggcggactgattggggttgtgagtgataatcagacggctgccagcggtctgtccgttcctgccatgctgcttacttcctttattcccatgctgtcaatgtttaatgcctccatacgcaatgttggaaaatttctatattctcaacagatttatgagcagatcaacaacagctctacgattgttctgtccgcacagtcatttgttgtgatactgataaattttgctcttgtgctcgtgctgtatgtgtacatgtatagaaagaagcagctgcttgcttcataataaagtaaaacccggtatgtcgagcatgccgggtttctacttagttcaaacggtaaactacatgcaggaaaattttaagcctgcttcactgtaacagatccgacatcgtggaaatgaagtcctcataggattgacatccgcacagcttcttgacattttccggtgtgcttaaaatcatggtaatcggatcaaaaatctcattgaaaatataacggtcacttttgttaaagcaaagcatgagcaccagatacacatcctgctggttccatgatatcggcgtttcactgataacaatattcatccctgtctttttggcatgcattttcattgcatgcggaatcgcaaagctgccaaaagctgtcgaggacatattctcacgggatattatttcattctcaaattcatcatccacatatccatgcacaatcagtttatttaccatatatgttatacactctttttctgtagaaaatccactcttcaggacctcaaagaaatcaggcagaagcagctctttcaaatagccttcaaaaacgctgcgtttttttaatttacggattgtttctattttttcatttaacagctgcctgtccttttgattgaggaatatgctaatctgtatcataggtatggaagtaattacagaaacaggtattgtagttatgatgagatttgtatccttaattttatcaaaatcactttcatcggtaagtatatttgtaatcagcaattcatcagaataatagcgcttgatcacatcggtaaccttcagactcatatcgtaatagctgggacaatacaacgctacagttattttttctgtcaggcttttctgtgcctccagggcgcttcccagatgaaaggcaatataggcaatttcatcatcgtttatagaaattcctgttttttcttttatcgttgcggcaagagaaaccgatacatcataaatcagaggacaggaggttttaataccatccgcgagtggatttttactgaagtaattgttcttggagcgcaccagtaaatttttgatatgaagggcgaaccggataagaaattcctgttcactcaaatcaatataatagaaggagttgatatcgagaatcagctcttttaccagattcagacattcctttccgataaaatcctccaggtttgcggcattgatacttttataatcaattgttgttgccctggaaataatcagcagtgtcatttcataaatttccgccttactgtaggtgatatgaaaatgttcttccagacgtcctgccactttttccgcaagctcatactcatgcaggtgaaccgccggctgctggtcaatgctcgttgtattgatattgttcttccggatacggtcaatcgcaatggtgatatgcaagaccagattgattaaagaatagtcattgataaaataatggtaatcctcaaatatctgtaataccgtattcttaatatacggaatatcaatatccagaaaggagttttgtaatgattttaaattgacaaaattaacattggattcattatataacagggtgctgagtaatttgcgcttgactttttgcagctcattcttgatggtagaaaggctgataaacaattcatcacataaatcatatatatcaattgcttcctcctgatgatgattgatcagctgatttaaaatatagattacacgttcttccgaagtctggggaatatgatctgcagtttcatccagtatggatttcgctaattccatatccagacggtatccttcccttgatgaatgaatagcttcgggatattcttcattgatttcacgtacataatttttgatactgcgtacagaaacattcagatgattggctaataaattggtatttgccggttgtaggtcaaataaagcacggagtagctctttgtttttctgtttcatttcatcacctgctttttgttcagaaatcactatatgttaaaattatattttaccggactgtaattctcaaccagaattttgcacgagcttggggaaaataattatctgcccctacagcgtgcaaaacatgattagaaatttaaaaaccgatttggcatactataggtgtgatgaggcgaagaagcctgaaaggaagattattatggaaaaattaaatgtattactcgtctgcggttccggagcaagctccggattcatggcagccaatatgagaaaggctgcatccaaacagggacttgatattgatatcaaagcacgtagtgaatcagagattgaaaactatattgatgaaatcaatgtcctgatggttggaccacacctggcttatattctggatgaggttgaggagtatacacatggggaggatgtcaaggtaattttaatggaaccggattattactctgtattaaacggagaaatggcgattgcccacttacttgaggaaatggaaaaataatcgttactgagaaagggagatacatatgaataatttaataaactggcttgaaaatagttttgcgccgaaaatgaataagtttaaccacaacacctgggtcgttacgataaaggactctatcatgcaggtactgccatttatcctgctgggatccctgttttgtgtgggaacggttatcgaagggtttgtgactctgcccttttccttctggacaccttatgggtggacaatgggaatgatttctgtacttgtcagctttctgattccgtttaacttctgtgagaagaaacgattgagaaagcagagaattatcgccggtgcaaccggtctgattctattctttatatccattactccggagcttgtcaaagcaggggaaccggggtttggttccagtgcatttggtgcaggcggaatgttctgtgcaatgtttaccggtattgtgaccagtattgtatttaatctgtttggcaaattctcattcattaaagaagacagtgcaatcccggattttgtacgtcagtggtttgatgcattattgccaattggcggaatcatattcaccgggtttattgtggtacaggtattgaacatcgatttatatgcgattatcacttccttctttatgccattacagggtattatgaatacatggtatggattcatcctggtctgctttctggaatgctttatttattccatgggtatttcttcatgggttcttgcacctgcgacatctcctgtaaagttacagagcatcgccgcaaatatcgcactggcaactgcaggaacagcgtctgtagcgaacctgaacatgtatacggaatcctgcgtctatacctgctatctgtggatcggtggaattgcctgcaccatgccgctggttatcttccttgcattatccaagtcgaagaagctgaaatctttaggtcgtgcctgtattggaccaacgattttcaatatcaatgaacctgtggtgttcggctgtattgcatggaaccctgttatgatgctgcctatgtggattaacggtatcgtgttaccggcattggtgtggatcgcatgtaaggtaatcgccattgccccgattcctaaaattcagtttgaaatgtggtattgtccattcccgatttccacatggatcacatcggaaggatccattatggccattgcagtcatgctgattatatttgttgtcggcggtgcgatctggtacccgttcttcaaagcctatgaaaagcagtgtattgatgaggaaactgcaacagaagcagctgctgaataatagtgagaggagagttattatgatgagtgaacaaacagtacaatccgcaatgtctattatcttgcatgccggggatgcccgggtcgcatgcaaggaggcactggatgccatatccgaagcggattttgaaacagctgaggtaaaattaaaggaagcacaaacaaaaattacagaggctcataaagtgcagaccgatgcaattcagggagaaacccgtggtgatgagtcggaatattctcttctgtttgcgcatgcacaggatacgttaatgacgatttacagtgaaatcaatattgcgaaacagctgctgaaaatattcagtgcttatgagaaacgtatctctgcattggaaaaataaagattgttaaggaggcaaatatgtcaagaataccggatgggtttccaaaagatttcctgtggggtggcgctgtagctgcaaatcagctggagggtgcctatacagcaggaggaaaaggattatgtgttgcggatatcaatgagttccgtgatgatattgatattacaaagaaatataatgatgaagttacttccacctacgtgaaggatgcaatgaatgccggaaacaatgatggaagggtgtttccaaaacgccggggtattgatttctaccatacatataaagaggatctcagactgctggctgaattaggactgaagaccttccgtaccagcatcaactgggcgagaatatttccgaatggggatgatgaagctcctaatgaggaaggcttaaagttctatgatgcgcttttcgatgagattctcaaacacaatatggtgccgatgattaccgtgtcccattatgagatgccgttacatcttacgctgaagtacaagggctggtattccagagaaaccatttctttctttgagaactactgcaaagtgatttttgaccgctatcatgataaggttaagcactggattctggtaaaccagatcaacttgatttctcatgaatcctttaaccatctgggtgttgccgaagatatggttgatgatttaaagagtgcgaaatatcaggctgtgcataatgaaatggtcgcttgtgcacgcgctacacgatatgcacacgcaacgtatccggatttacaaattggtatgatgctgtgcggcggacatgattatgcggcaacttccaagccggaggatcagctggcagcccttcagcataatcagatggaatatttttactcggatgtacttttgagaggcgtgtatccgggatatgccctgcgcttcttcgaggatcatgatattcatgtggaatttggagaacaggatgaagaggatttgaagaatacatgtgatttcttctccttctcctattattacactcgtattgtgacaaaagaaagctttgaaaacggaaatgactccatccgtaataaagaactgcccgcaaatgaatggggctggacctatgatccgatcggattgagaattttattgaataccttctgggatcgttatcagaagccgatttatattacagaaaacggaagcgggttctatgataaactggaaaatggtcatattcatgatccgtaccgtgttgatttctatcggaatcatttcgaacagatcaaagaagcaatccgtgatggtgtggatgtcagaggctattatgcatggggaccgattgacatcatttcctgttcctcttctgaaatgtcaaaacgctatggattcatttatgtagattatgatgattatggaaagggcagtggggaaagaataaaaaaagacagcttcgcctggtacaaaaaggttatagaaacaaatggcgaggagttggattaacttataaataaaacaaaggagatatttcatcgtttttaatggtggagtatctttctttttcatgctttaaaatgataaacattacactgctgatatgaatagatactataagtagacacacaatagggaagagtacgggatatcgttctaaaatatgctataatgaaggagcatgaaagagagaagggatacttttgaaattaagcaataaagaattggtgcaggatacgttgtggatccttgcgggaaatattgctctggccatgggggttgcctggtttatattgcccaatgatgtactgacggggggcctggcgggtgttgcaatcgcactggagccgctgattcatttgaatcctgaactggtgatcaatgtactgaccgtcgtactgtttcttgcaggatcacttgtcctggggaaaaagtttgcggcaaaaacgattctgagtacaatctgttatccgctgctgcttactttactgtcctatctggcaaaacatgtgattgctccggatacctttatcatggataaatatttagccaccatttacggcggtgcgctgatgggcatcggtgtcggctgtgtgtttcgtacaggtgccagtaccggtggtatggatattccaccactgatcattaacaagtatacccatataccgcttccgacactggttttgattgtggacgcgcttaccgtactgcttggtgctgccgtatacggactgcaggctgcacttacaggaattctgtcagtctgggtaagcagctatatgatcaataaaaccatgatgatcggtggacatgatgcgcgtaatgtgatgatcgtatccaataagcatacggaaattatggaccgtattcatgaggtgttggagcgcgggactacgattctggaagcaaccggcggctattcttctgagaaacgaccggtcataatggctgtggtatccaaaaagcagctgccggagctggagcatctggtgtcgcatattgatccggaggcatttgttatcgtaatggaagcaaatgaagtacagggtcttgggttcacttatgaggaggagctatagcttttcctatataatatagaataatatagaagtttatggaaggaggcggaaatatgcagaattttaactatcacagtcatacagaacggtgcgggcatgctgtaggaagtgatgaagcgtatgtaaaggaagcgataaagaatgggtatcggtatatgggtttcagtgaccatgccccgtatcgtaacggtgatgcaccgggagagcgtatgcgggtggaagagcttgcagactatgtgagcagtgtgagaaagctgcagcatacttatcagaatcaaatcgaaatccgtctggggatggaaatcgaatattttgaggaacagctggatgagcttatgcaatataaggaagagatggattatctcattctcggacagcatggccctgcattgtatgcgccggaattttatgataatcacagcgatgcggatgtactgcactatgcttccctgattgaaaaggcctgtgagaagggattaccggatatcattgcgcatcctgatctgtttatgtttggaaaggaagtctggacagaagcctgttgtgaggctgcccatagaatctgtgcaagtgcacaaaagcacggggttattctggaggtcaatctgaacggcctgcgctatgggaaacgcaagctgggagaggaatttcgctacacctatccatatcgcagcttctgggagattgcctgtacctatgatgtggatatcgtctatggtctggatgcacatgcacctcaaaagtatgccgatcaggattgctttgctattgtgaatcaggaaattctatatgatctgccgttgaaattccgcaacgagctgcggtttgaagacaggaacagggggaactgagatgctgaaggaagctatgtataaaagacattcccgaagaagctatctgcgagagaaattgcgggatgaggatgcagcctttttaaaggaacgcattcatatgtataaccagaagcacggattgcatatgaagctggtatgcggacatccggaaatctttaagggatttcgcaacagctacggcatgtttcacaatgttgagaatttcattatgatgatgggcaattcccgtgatgtatatatgcaggagaagctgggatatttcggtgaacgactgattctggaggcggtagagcgcaatatgggaacctgctgggttggcggtacctttgcgaaagatgctttaaagccctatgtaaaggaagatgagaagctgtactgcgttatcgcgatcggctataccgcacataagaaaaccttaaaggaacagctgatttcgcatgcaacacggcacagaggaaaaaccgtggaggaaatgtcagatatcacagcgcacagtccggattggatgaaaaacggaatggaggcagtgcagctggcaccctcagcactttttaaacagccggtgcgcttccgtcaggaaaaggatcgtgcttatgctgaggttgcccatacggattcctttgaaatggtggatttgggaatcgccatgctgcactttgaaatcggtgcacaaaaaggtacctggacatggggaaatcctgctgtctatgagaaaaaataaatagatgaaaattcagaggcttatttgccttaggatataatagaagtagctttttatgaaattttataatatttatgaaaaggaagatgtggcagccttagccttatatcatcttcccttttattcattcgcttcaatttactacggttaagcatttgtctgtgacataagaatctctttatcagacacctttttcttttaaacagcttaatcatttatatgttactgtgttagaattaaaaaccgctgcaccgctttttataacaggcaatacacgcaacgagaaaacttgactgtattgggtggaggtatcttcgtttgcacagctgcatcaaaggggagtgagagcccttgtttttcaggcagggtgtatggtatgcatttacttttgaaagatggatatctcattttctttcaccgataatctgctgtcgttgtcatagcttgtcatataaatgccatgtctgtggaaaattctgaatcctgttgctgctgcatgcataaaattaaaggaaaggtaggacatcatcctctttgagtcttgcaaagcaaacttttctgtgttaacgtttacaatggctagatgtttaaaactatggaggagagtatatggaattacttcgtttttcttatacgaatctgagccgaaagcctgcagatgcgttcttttttgcattctcgatgttctccgcttcccttgtgattacgatgtttttcgcaatcatcgcaaatccctattacggaagtgagtcattgcgtgatgcctctgcaatgtcacagggtggaatgtcgcttgttgcttcctttgatggaggcatcggatccggaatctttacgatgatgctgtctttgtttatgattttcatctgcatactgacagtctttttttcaaacaaattttttctgatgtcaaaaacacatgatattggtgtaatgatgatcagcggtagcagtattattcgaatagccaagttcctgattgtgcaaaattttatgatcatgggaattgcagcaccgctgggagctcttgccggctgctgtgtgtttccgctggtgaatcatgtcatctatctgtcgatgaatatacaggcacctgtattcaccttttcttccgcagcccttggatattgcatcgctacccttgtgattgtttccgtatggctggttattgtcgatgcaggctttgtctatcgcatggattccatgaatgaactgctgcgtgccagacggtcgatgaatccgattggaaaacagaagcaggtatttatgaaaatcgtatatgtatgtgtgtatgcgttgaccatatatctgctgttctcgattgattatcattatatgaatgccatttttctgatatatcttggtgtagccatcgtattcggcgcagggaatgtatttcgttatatacttccggatgtattaaccctgatgaaaaaacggatgtttgcagaaaatcgccattttctgatatctttgggaaatctgcgctacagcatggtcaacggaaatcttctggttacgattattttattgtcgacagcggtattatttctatatctgtgtaaattttataacgacacggcaacttttatggttgttatgatcgcctttctcgtatcgatgcttcaaatcagtatctgtcttgtttataagctgtctgccgacggattgagtaagtgtcaggtctttcgcaatatgacggcgatcgggtatttgaaaacggatatccgaaaaattatcaagcaggaaatcgtcggcttttacggcatcattctgttgttatctctgccgcctttactggtcataacttcattgtttgcggcaggaggggatgtggcgtggagctttgtattacagctgcacggcttgtatatcggctttttgctggtggcagctgtggtgatgtatcgcatttatatgaaactgattttccgtcaggatctgatggaagcatatatggaggaataggagagcagaatatgaatactatattggaagctaagaatataacgaagatttataatcgtcatacaaaaaatgaatttgaagcattgcgcggcatttcactggaagtgcacgaaggagattttatatgtatcatgggacccagcggttccgggaagtccacgctgatcaacaacctttccacaattgatacgccgacaaagggaaaggtgaagatcaatggcattgatgtctacagtatgctggaatctcaaacgggaaaattccggtatgaaaatctaggatttatctttcagtcctttaatttgatggatactctgacgctgaaggaaaatatcgcattgcctcttaccctgtcaaacatgtcgaaggaggaaatcggaatacgtgtgcagcaaaccgcagagaggctggagctatgtttctatacgcagttcatctgcatatggaaacattttatattttcttagaatgcggcatacgattccttttttataagagaggatgctcttagaaaactcgaaataccgttacagtcactgcggccgcataccgcatctgcatggagcattacttcctttttcgcatgttccatggcaataccaagacacacgtcctttagcatgggaatatctgttctgatatcgccaaagcatagataatcgtgtccgggaagcctccacagcttcatcagctggtgaatgcctgtggcttttgtcacgcctgccggaattaaatccgtattgcgatggccggaataggtaattgcgacatccaacagcttctcaaaataggggtcatagtgaaagcctttttcctgcagtctgtgtactgcatctatatttgcaggtggaatctgtccatgcacctgattaaagcaggtgttgccgatatcaaagaaagcggctctgaaatcggttaggtgcctgccatatttcattttcatacctattgtatagtagaaattgtatactaaaaaatactgtctattatcaaatactgtgagcgctcaaatgcagatggtgaatgaaaatctgaccctttgggatagaaaatgtatggtattgggaggggaaagacccttttatatataaggaagcgtagattcccgtatgttttctgcacatttgacggtttgtatgatataatgcataattgttaacaccggaggtagaaaaatgatagaaacgcaaaatgtcagtgtacgttttggatcacgaacactgtatgataatgtaaacttaaaattcacagatggtaactgttatggcctgatcggggcaaacggtgccggaaaatccacattcctgagagtactcagcggtgagctgaagccggataccggctctgtcatcatcaagccgaatgaaacggtatttacactgaagcaggatcactttgcttttgatgagtacacggtactggaaacggtactgatgggaaatacaaagctgtatgaagtaaaacgggaaaaggatgaaatttactgcaaggaggatttcagtgaagcagacggtatccgtgctggcgagctggaagcggcctttgcggatatggatggctggaatgcggaaattaacgcggcaacgctgttaaacggcctgggaatttcagtggatctgcatgatgtattgatgaaggagctgtccggtagtgataaggtaaaggtgctgctggcacaggcgttgtttggaaagccgaatacgctgctgctggatgagcctaccaaccatctggatatcaaggcatgctcctggctcgagcatttcctgatgaattatgagaacacggtaatcgtagtcagtcatgaccgtcactttttaaacaaggtatgtacacatattgccgatgtggattatggcaagattaagctgtttgcgggaaattatgatttctggtatgaatccagccagctgatcagccgtcagctgaaggatgccaacagcaaaaaggaagagaaaatcaaagagctggaagactttattgcccgcttctctgccaatgcttccaaatccagacaggcgacatcacgaaagaaaattctggataagataacactggatgatttacagccatctactcgaaaatatccgtttattgaatttaaaccggagagggagagtggtcgttctatattgtatattgaggatgtagagaaacaggtcgaagattgcagactgacaaatatctcctttaacatgatgaagggagataaggtggcgctgattggcaatccactgaaaaccactctgctgttaaagctgattgcacaggagctgacaccggatgccggaagcattcagcttggacagaccatcaaggtttcctacataccggatgataacagcgcgtattttgaaggtacgcagagtatctgtgagtggctgagccagtatacggatatcgatgatatgtcctttatccgcggtttccttggaagaatgctgtttagcggagaagaaccgctgaagcctgtcaatgtgttatccggtggagagaaggcgcgctgtatgctgtccaagacgatgctggaggcgggaaatctgctgttgatggatgatccgatcaaccatctggatctggaatccattcagacattgaataatgctctgataaaatatccgggagaactgatttttgtaagtcatgaccatcaattcattcagacaatcgcaaatcgtatcatagaaatcagagatgacggtatcattgaccgccgaacaacgtatgatgactatctggaaaaggaatacggaatcgaagaatagaaataaaattgcccgaaaatagggctttttttcgtattttcttcacaagtggagaaaacggtgcgataaagcgataaacaggggagcgacagcggtttcagaaaactgaaacaaatgaaaaaacaaatatcatttgtgaacagataccgaattatcacaaataaattttcacataaaaatcagatatctgacataatatagttcatagatacctttatttaaagggtctggcataaatgcctctgcaaattcatatgtataaaatacaatgtagaggggaaaataaacataaatgcatgttaaaaaacaaaaatattggacaagtcaaaaaaagtatgctagactagtgtctgtttcgtaaaaggaggaacatcaatgaactcaaaacgaataaaattcgctttattcatctgtgttttcgctttatatggatgtgcttccagtgcctctgtaccgcagaagtcactgaacactgtgaataacaaacatacggtatctcaggatacccttcatacaaacagtctgattcagacaaaggataccagcatggccgccatggcttttcatgcctatggtcctatgcaaaaaagtggctccatgtttcgcagcatgagggatgagcatggtgtgctgctgatgaaatccgatgtcgaaggctatgcgaaaaaaatgaaagaaaaggttgtaaaggaacggaagcgtcaagtgcagctggagaaaaaaagaaaagaacaggaacgcctgaaaaggatggaaaaggagtcctcacaggcattcagtccgaaaatcacaacctacggcgttgactgctatggatgtggcggcgaaagcggccgcggcggtacttccctaggtgtggcactggatttaacccttggtgtacagatgccggatggctcatggcagccgggtatccggtatggtaattattatatcgttgccgcagacccaagcattccgctttgctcgatactgaaaatcagtgatcacggtctgagtggaagtggtattacaccggatcagccctactatgccattgtactggaccgaggcggggctattcagggaaatcatatcgacctgtatatcggcagtgagaactccggtgctatcgtaccggtgaaaaacacacaggcaaaggcgcagatcatccgtgagggtggtaaaaacggagccagaagctgtgcattataatcatcaggacatggaagctggttttctgtgtccttttgcttttacaaaaagctaagctggtattctctatatttaaaatgatataattatggtactatagtaattaaggaaaggctgatgcttgtgaagatgaaagaaatccttgtggttgagggaaaaaacgacacaaatgtactgaaaagctttctggactgtgataccatagaaacaaacggtacgcatttggggaaagaaatcctgcgacagatcagacttgctcagaaaacgcgcggtgtgattatatttaccgatccggattttcccggagaaaaaatacgttcctgcatcaatgcggcagtacccggctgtaaaaatgccttcattgataaggcaaaggccaaaacaagcaaaaaggttggtgtggagcatgcctgcaaggaagatattctggaggcattaacgcatctgatgacctttgatgaacatctgcaggttacactgagctatgaggaatatctggatctgggactaaacggcagagaggacagtgccgaaaagagagcgcagattgcccgctccctgcatctgggaaaaccgaatgccaaaacacttttcaagcgtctgaatatgctgcagctgcataaaacagatgtggaaaagctgcttggacagccatatgaatgagcttgttaaggtaacgtttgccctgcgtcccaaggaacaactggaaggctgggtatctgaaatcctgcaggagggatgggaattgtcctcctttcgctatgtcatgcttggctctttgatgaattttcgttttgtagagggaaaacgacggcatgtgcgggtttgcttctatgatgtgaaatacgatgcagatgaaagcatctttctggccgagggatggaacgtgctttgccgaaacggtctgagcgttattttctatcatgaaaatcttgatcagccgctgccgcttctggatatgaagctgtatacgaagcgaagaatcttcaaaatgacatgcaatttgctgtatctgttttcattgctgtattgtgtgcgagtggaggaggaggcattgcggaagccgcttcttttcgtctttacccttctattgtttgcgctgccgctgctgtttgatgtcaaaagcacgacaaaatacagtaatctgattcgaattataaaaaacctgttgtatgcagtgcttttgacaggtattgtatatctgctgatagaattgctggtatccaccttctatctgctgttttagaaaggataagcttatgaagaaacccattgcgacaccttccagaacaaaggaaattctggaaacacatggaatgtttgcgaaaaaaaattacggacagaattttctgattgaatccggaattgtcgataaaattgcacgacatgcagtcctgtcggatcactgcgtggtatttgaaataggacccggtatcggtgcattgacacagtatctgtgtgagtatgcaaaaaaggttgtatcctttgaaattgatgagaggcttcctgatgttctggcagacacgctgcaggaatatgacaattttgagctggtcatgtctgattttttagaaatcgatttgaaagaatggtgcagaacgtacagggaagagggctatgatgtcgtcattgctgccaatctgccatactatatcacgactccgattctgtttaaaatctttgaatccaaagcggacgttgcggcaatcaccgtcatgatgcagaaggaggtcgcagaccgcttcgctgctgaagtaaataccaaggattacaatgcgttaagtattatcacacagtatcgctgtgaggtaaccccggtgatgaaggtgccgaaaaacgttttcctgccaaagccgaatgtggacagcgcagtcttgcagttccgtttcagggatacaccgcagaatatcgaggaagaaagtttttttccattggtcaaggcttgctttcgccagagaagaaagaccatactgaacaattacggggaatattgtcaggataagcagcaggcgcgtgcagagcttgagaaaagcggtatagactgcacaagacgggcagaaagcgtcacacttgcggaatttatcaacttatatgaggtacatagaaatgaaagtaaaagcacatgcgaaaattaacatctgcctgaatgtcgtatgcaggcgggatgacgggtatcatgagctggaaatgattatggttcctctgatgctccatgatgagcttaccataacagtgtccagtgaggactgctatacgtgtaatgatgcacagctgcggatggatgaaacgaatacaatcgttcaggcggtggagctgatgcgaaggaccttttccctatcggaatgcttccatgtgcatgtggagaagcatatccccgcacaggcaggacttgccggaggaagtgcagatgccgctgcagtcatgcgtggaatccgtgatttgctgaagctggatatctcactggaggagctggcacagctgggaaagcaggttggcgcagatgtaccgttctgcatcatggaaacctgtgctctggtaaaggggattggcgaaaggataacaccgttcgccatgccttgcgattttcatattcttctggtgaagccagcgatgggcgtacctaccgggaaagctttttctatgcttgattttgagaaatgcgaccatccgaactgcaatgaggttatccatgcattacagcagggcgaccttgcgcagctttcaagtgtcatatccaattccctggaatacagtgcctttcagctggttccggaaattgcggacatcaaacaccagctgcagagtatggggtttgaagcggtgctgatgagtggcagcggaagtacggtatttgcaattacaaggaagaaggaacttctgcggcaagcagagaagcggttccataacaaaacgtattttgtatgctgcacagcaatcaagcagtaaatggaggttaaggctatagacaaacaggggatatctcttctttgatgtctgccttagtgctggcttcataaagaaaaaacggcataggattaccggtttcggtttatctgtgccattttcatattatccgtatgaaagccttcatagatccccacaggattcaaaatgctacagcttggatatatccggcttttgaatgggtggattcggcagcgtgctttctctgatatccgtaagcagaagctgttcatgccgaaagaaatatgggtgatgccgaaaacgggtgaacaggaagagcaggcttatgaaaagtcctgtataaagcaggacggcatacaacaaatccagaaacatcataaacaataggaaacagggaacaccggtaagtaatataaagacgcccattccgatataggtgagaacacaatttccatatgttatcataagagaatacaaccgatcctgccaggtgatcagactgcgctccagctccgtataaggaagccatacagtcccggtatcatcctgcagcagtattttgcgaaatgcagagatatcctcagtctgtaaagcctcaccgacatattccctgcgcagaagcttaaaaaagggctgctttcgcatatgtctgttaccggtaatgaggtcaccgccacagcattgcgtcctgccacagagggttcggtacagctccggtatgagataggcgggatgacgggtgtctgtgagcataagaaagtcaccgtttgacagctgtgctcccagaaatatagcagacaccggcgtaacacggtgattcagtgatacgtaatggcatgcataatcctgctgtgacagcaagcgcagaatagcggagcttccgtctctggacgcattgtcaataaaaagaagctcatagctgaccggcagcttctttacttcccgcaggacatccgtatacactctgcgtaatgctcccgcattattatgacagggtataatgacactgatcttatccacaccatcactcctttataaacattatggcatactattgtgataaatccagttttgaaatcttaaaaagtcttaacactgatttaatgaacattaggtagtaggagcctgtattttgatatataatgaaagagaaaagaaatgaggtgtggacgatgggaagcagaatactcattgtggatgataatcaggaaattcgtgaggtagtaactgttcttctggagaacgagggctatgaggtggaggaagccggtgatggagaagcagcagtagctaaagcagaggatatggacttaatcattctggatgttatgatgccgaaaatggatggctttaaggcatgccgtcagattcgtgaggtcacgaatgcgccgattctgtttttgactgcaaagaccatggaccaggacaaagcgcttggattttccagcggcggagatgattatttggcgaagccgttttcctataatgaactcattgcccgtgtgaaagcacttctgcgcagatattgcatttacaaggggaaggaggagccgcaggagggcgatcagattatcatgcatgatctgatcatcagccgaaacagcaatcaggtgaaaaagaaggaggaagctgtaaatttgacagaaatggagtatcagattttgttactgctggcggaccatccgaaaaaaattttctccaatcaggagctgtatgaagctatctggaaggggccgtatatgtattccgcaaataataccatcatggtgcatatccgaaatctgcgcaaaaagctgggagtggatccgcagaatccggtgtatataaaaaccgtctggggaaaggggtaccgttttgattaagaaaaaaagccctgtcggaacaagaaaaaagcatatctccaagctaagcctgaaatttatcggtatcgttatactggcggcagttgtttccgcatcactgttcgggtttttattttttaaccggtatcgtatgtttcatctggctgtcggtgaagaggcagtaaagaaggaaacgagtgaacagattcagaccctgcaggatacgataacgaaaaaggatatttcgaaaaagaataaaaaagccatcaaacgggaaatgagaaaatacaaggatctcacgctgtatctgtatgatgatgaggatacgctgagtgaaacatcattcagtacgatggaggatcaggcatatgtgggtaccatgtccttctggctgaatctgtatgagccggacgatcaggaatatacgctgaagtttcatgatggtgaagcctatcttgttgtctattcctttatcggtctttccttcatgattcggtttctcattgtggcggcagttgcttctatcctgctgttcattgtagtgattatgcagtttgtacaccgcaaaatgaaatatgtcctcagtatcgaggaggaaatgcagctgattgaagccggtgattttcaccatacgatcatttacaagggaaatgatgaattgacggatcttgcccggcagctgaatcatctgcgcaatgcattgtatgataatatgctgaaggaagaagaagcccgcaatgccaatcaggagcttgttacagccatgtcacatgatcttcgtacaccgctcacctctctgcttggatatctggatattcttcaaatgaaaatttataagagtgatgcagcgagggatgactatattcgaaaaagccggcagaaggccgaacagatcaaggatatgtcagataagctgtttaatcatttccttgtgtattcccgtgatgaggagctgcagctgcatcccatagaggagcaggcggtactgaatatgctggagttctattgcgaggagctgcgtgaacagaaattcgagatattgacaaaatttgaaaggggcagctggaaaatcatgggggaggaagccatgctgatgcgtgtgtttgataatgtattttccaatatccgaaaatatggggataaacacattgtgactgtttctttacaggtggagaaggggaatgtgctgattcggttaaaaaatcgtaagaaaaaggacgcatcccgggaggaaagcacccagattggtctgaaaagcgttaataagatcatgaaagggatgaatggcagctttttatatgaaaatgatgatacggaatttgttgtagagctgttctttccttgccgtcaggaatagcactgctatattcgtgttagacatgtaaaaagaatagttctgcatttctgcagcatatatgtaacaaggcatctgttgtctgtcctgcacaaacacagctgcttttttatgattagttctgcattaaacggtaaattgaccttctaacggaaaaaggatgaaatgcggaagggagtaaaaaaacagcctggataaccaagctgtcataatgcaggggattataaatccagcagcctcatctgccgcaatgcatgatatatgccatcctcggatacatcccttgtgatgatgtcggcagcgcgcttcgcttcctcatgggcatttcccattgcgactccgattcgtgcatgctgcagcatttccacatcgttcagactgtctccaaaggctagatagtcctgcatctgaaaatgatcaagaataaagcggataccgatcgccttgctaaagcccttcagcacaacatctgcataggtcgactgcccgatcaaaacatcaacgctgggtatcgccatatattcctcatacgcatatcccataggaccataggcaatcatcataatgacatcactgccgtcatatgcttccacatccggtatggattccttaaagaattctgcagaggtaatcacgtatgcattcggcttgcgggtaagaatctgcttctttcccataatcagcagcggagcctcctgcgtttccgcagcctgaatgcaggcctcgacgctttctcttggaatcggtgtcatatgcagaaggcttttgtcgtgattgtaaatagcctgtccgttattgcagagaaagatgtcccagtcaatcagctcatcaaagtgaccgtctgttacagattgcagagatcgtccggtagaaatgcatagaatatggccggccttcttcagcttctgcaatgcggctctggtggatgcaggaacaatatgcgtggtactatccaccaaagtaccgtctatatcgaaaaacagaatctgtctgttcataaggtaacctcccatcaacacggttatgatagcacaactattcacatattgtaatcatttccggcatatttcattattccggtgtccgaaatccaatttgcatgatggtaaagtaaacgggagcatgctgtttcctccattctttgctgtgattgtatgctttttccttaattcacggtgaaaccttacaattcgtccataaaacgtataggaaataggcacttagccttttttttactgtcactttttgataaaatagtaacggaggtatgtttttatgaaatctgctattgttttagctgccggaaaaggcacaagaatgaagtcagctttgaacaaagtgatgcatcccgtcttaaacaaaccgatgattggacatattgttgataccctgaaagcaagcggagtggaacgcattgttgttgtggttggacatggtgctgaaagtgtaaaggaatatctgcaggattctgtagagtatgctattcaacagcctcagttaggaaccggacacgctgtcatgcaggcaagtgttctggaaggtctggatggagataccattgttgttaacggtgatggcccctgcattcagaaggaaacgattcaaaaagtatttgaaagcaaccgtgatgccgcttgtaccgtactgacgagtgtgctgccggatggagaacgctacggcagaattattcgaaatgcacagggcatggtcgagaagattgttgaagcaaaggattgcagtgaagaagaattggaagtaaaagagatcaacaccggaattttctgtttcaataacaaggcactgtttgaaggtctgaaggaaatcaccaacagcaatgcacagcaggaatactacctgacagatcttgtggaaatttttaataaaaaagatctgtgtgtcaatgctatgattgtggatgatccaaaggaagccatgggtgtcaatgaccgtgtggatttagcgaaagcaaatgcatggatgaagcgtcatgtaaatgaagcacacatgcgtgcaggggtaacgattatcgatccggataacacatacattgatgtggatgctgtgattggtgaggatacggtcatttatcccaacgtacacattcaggggaaaactgtcattggtaagaatactgtgattttaccgaactcgttcctgcgcaatgctgtaatcggtgatgatgtaacgattgacagcagcaagatcgttgaaagcagtgttggaaaccgttccacggtggggccgatgtctcatttaagaaacaatacagaaatctgcgaagactgccgtattgggaactttgtggaatttaaaaactctcactttggtgatggctccaaatgcgcccacctgacatatatcggagattccgactttggtaagaaaatcaatgtcggctgcggtgtggttacagtcaattatgacggcaagcacaaattccgcacaacggtacatgacggtgcgtttatcggaagtaattgtaacctgattgcgcctgtgaccatcggtgagaatgctctgcttgcggcaggctctacgatcacggattctgtagatgacggtgatatggggattgccagagcacgacagtccattaaaaagggattcggaacaacttacaagaacaaataggaaaggaacaggattgtagaacaatggaaaacaaaacagtagtttttgcgttaacttcaagcgttgagctagcaaatgaaatcgtgggagaattagggatacctttgggtcagtgtgatgtaaagcacttctccgacggggaaatcatggtagaattaggggagtccgtgcgcgggaaaaacgtctacatcgttcaatccacatgtgcacctgtctccagcaatatcatggaggtactgattgccattgatgcctgcaaacgtgccagtgccggtcatatttctgtcgttatgccatatttcggatatgcacgtcaggaccgcaaggcaaaaccgagacagccgatcacatccaaactggttgcggatctgctggaacgggcaggggcaaaccgtgtcattaccatggaactgcatgcaacgcagattcagggattcttcgatattcctgcagatgacatctccgccatctgtattatcggtcagtatttcaagagcctgaatctgaaagatgttgtggtcgtatcaccggaccatggcggaactactcgtgcgagaagacttgcggaaattcttcacgctccattagcaatcattgataaacgtcgtccgaaaccaaacgtggcagaggctatgaacatcattggggatgtaaatggcaaaatcgctatcgtggtagacgatattgtggatactgcagggacgctgactgcaggtatccagatgctgtatgacaaaggcgctactgctgtatatgcatcctgtgtgcacggcgttctttccgggccggccatcgatcgcttgaaggctgcgaatctggaagaattcgtatgtaccaatacgattcctcaggatgacaaggctgcattgtacccacagatgaaggtattgtctgtaggacctgttttaggacaggttatcaaggctgtggaagaaagcagaccagtcagcgaaatcgttgcgaaatacgcagagtaagcctacatagaaaggaaactgtatgctggaacatttcatagaattcatgctgccggagattgtatccattttggaaatcatcggtatcgttgtgataaccatcggatcactgaaggcgttttatcactatatcaaagcgctgtttacccataaacattatccgatccgtatcgaactggcaaatgctctggcattaggtttggaatttaaaatgggtgccgaaatactgaagacggtactcgtcagaagcttttcggaaatctatattctgggagccatcattctgctgcgtgcacttctgtccttgatgatacattttgaaatcaagacggagaaggaacacggatccgcaagtgaggcatcaccgaataattattaacatgcagtacggtatcaattggatatcgtgctgcttttttctattcctgtgaaatcacttaatatgggtaaggcagaataattgtttgagattggttttataactgatcttataaggtgatgtgtcaattgctctgtgtatatatcacgatcaaccagggaacttcaggatagtggcataggatgtgatttttatatggaggtatatccttctttcaagctgtttattggaattgacagtatgggtctgtaacaggcttcatcattgtttgtttcactaagtgagcattcatatgaagaatgtgttaacaccttgtatgtatttggcaacaatcgggtttacataactgatggatagtgttcttcatagagtgattttttcgtgaaatccccagatgctttcgaaacttaaaaaattgtcttttttgaaagtgtgagccatgatcgaaaatcagattttgatatatggtaatgaaacgatagaattgcttatttaaaagatgtctttaaaccctataaattggaatttcattgaaatataagatatatcgtcactcttttcctttcaccatgacagctgtatgaataaaaagcgcatcaaaaagccatgcgatcactcacatggcttatctgcactagcttgctttataatatatgacagattcataaggacgaagtgtgatacacttgtcagctttactgtccttataattgcttagcaacagcacataatctgtcagattttcttttatttccacacgtacagcttctgcatagaaattgctgagtacaatcagttctccttcctctcctttgcgtttgtatgcaaagactgtcttatgatcctgcagtaatggaatatacaggccattctgaatcaccttatactctttccgcatgcgtatcaatttctgataatgataaaatacggaattttcatcctgtagtgcattttcaacattgacagttttatagttatcaattactgacagccatggagtaccatctgtgaagcctgcattttgcttgctgttccattgcattggtgttcttgcattatcccggctgcgttcctgtaatatatgcaggatttcttccttactgtgtccttccttcttaagaatatcatagaaatttgtactttctacatcgcgatattgtgatatatcatggaaatatgcattggtcataccgatttcctcaccctgatacacatacggtgtcccccgcatgcagtgaagcacagttgccagcattttagcggcttctatacgatagtttttatcatcgcaaaatcttgaaatcgcacggggctgatcgtgattacaccagaataaggcattccatgcatctgcttcctgcatacctgtctgccagtcattcaagagctgctttagctccatgaaatcaaacggcatcagctcccatttctttttgtttctatagtctacctttagatgatggaaggtaaatacactcgtcagctcatgggcgtcacttcctgagtaacgtgtgcaattctctaaggttgttgaactcatctcaccaaccgtcatactgtcttcatccttgccaaagctgttcagattcagttctttcaaatattcgtgaatgtgtggaccatccgtgtaaaactgccggccgtcaaagaggtttggatcatcctcgaaggagccttttgatacaagattaactacatcgaagcggaatccatgaacccccttactgcgccagaagttgacgatatcagccagttcttttctgacttccgaattgtcccagtttagatcagcctgtgtgacatcatacagatgcagatagtactcatccagctccttgacatattcccatgcaggaccgccaaactttgaattccagttattcggagcactgccatctgcttttcctttgcggaaaaagaagtaatctttgtatttctcttcgccctttaaagccttctgaaaccagacatgccgcgttgaagcatgattgaacaccatatccagcatgatatcaatgccacgcttttttgcttccctgcataattcagtaaaatcctccatggttccatagcgtggatcgattgctcgataatcttctacatcatagccattatcccgttgcggagatacaaacattgcattaaaccagatatactcaataccaagcttctgcagataatccagtctggaaatgacaccctgtaaatcgccccatccatctccattggaatcctgaaaggattttggataaatctgatatactgttttctctttaaaattcatagtgccctcctatttgtatgtgatgatatgagcatcaccagctgctatcttttcgtgctgtttttcaagtgtgatcgctgtcccgtccgtaaataccactggagaaacaagagatttttctttccttttgataacatccaactctacatcaaccagtacgtcaccctgttttacgacatccccagcttttacgtgcgggtggaagccttctccatttaattctacagtatccataccaatgtgaatcagaacctcttttccgttatctgccttgataccgtaggcgtggccggtcgggaatgcgaccatgatggttccgctgaacggagccagaacacgggtatcctgtaattctactgcaaagccgtcacccatagctttggatgcaaatgcctgatcctcaacttcttccatcggcatacatataccgctcattggtgaatggaagctttcctcttcggccgagacaatgactgcagcttccttttgctgcagtttctttttttcaacaagcagagtcaaaacaaacggaatgataatcgccgctgccatagctgcaaggaatgccagccaaaattgtgattttatggaaatgatgcccggtaaaccgccgacaccgatgctgaaggcctgcaccccgcatcctacagatatcactgctgcagctgcagaaccgatcatgccgcaaatcaaaggaaagccatatttcagattgacaccaaataaagccggttctgtaacaccgagatagcaggatatcagggccgggatattgatctgctgtgctttttcatcctttttctgaagaactgccattgcaagaacactggagccctgcgcaatattggataatgcaatcattggccagagaattgtaccgccaaacatattcgtcagcgttgtatcaattgcattcgtcatatgatgtaagccggtcataacgattggcgcatagatcagcccaaataccgcggcaaacaaaacgccaaagctggaggttagtccggtatagacaatatccgcaattgcatttcctattgtccagcctacaggtccaaccagagtatgagcaataacaactgccgggatcagtgaacagaacggcacaacaatcatagaaatgacagcagggcagtgcttacggaagaatttttcaagatatacgaggacaaagcctgccatcatggctgcgattacctgcccctgatagccaatcatttgaatctgtgtgaaaccaaaatcccatacaggaatagcggaagcctcggttccggctacctggaagccatttaacagctgcggagaaacaagggttagcccaaggatgattccaagaatctgtgttgttcccatttttttagtaatggaccatacgatacccaccggcagcatgtggaagacggcttcaccaatcagccatagaaagctgtatacgccattccagaactgtgaggcttgggcgagtgtctgtccgtcaaacatcgcaatctcgcctatgatattgcgaaacccgagaatcagaccgccgcagatcaacgccgggatcagaggtgcgaagatttctccaagagcacccattattcgctgtaatactgtctgatttgattttgcagagcttttcagtgaatccttggaaactccttcaatgcctgcataagccgtaaatgcattgtaaaattcactgacctcatttccgattatgacctgaaactgaccggattgtgtgaatgtcccctttgcactgggaagggattcgattgccgcaacatctgccagctccggctttaccagtacaaatcgcattctggtaacacagtgagaaacggcctgtatgttctctttaccaccgacgtatagcaatagtttttttacatcttcctgaaacttttccataagctcctccttaaacatgtacgtacatcttaatacaacaacagtataacttgtacgtacatgtatgtcaatatcttttttaaatgattattcatttctgtaaaagaacatatgcagcaggtagccgtctatccggtaatggtatttctaataaaaaagccggcaacttaccggctcatgctattatgctaattttacgcgtcttgcgaaatctttaaatcgaaatttatccgggcggtgtcttgcattggtatattgaaagattcgtgcatcatcaagataggagcaggactccacattcacaaccatatcatactgtttcatatccagaaccttcgtatccagaccgctcacgttctggcatgtgatttccttttccgcataggcgattttcagatgcagggtatcttcaatataggagtacaatgactgttccagaatctcttcgttcagctccggaataatagaagcatccagtatatccgtatccagaataacggcttcatggtcaatgatccgaaccctttgaacaagccagatttcatcctccgggctcatatgaaacaattgccggatacgggcatccggatgagttttttcaagacaaatcacctttgtctgcacatcctgttccattttatcggcaagctccttaaagctgacaacaccggaaaccggaaagtcatagcgctgtcggtccagaacaatacttcctcttcccttggatttctgtatatatccgttttgtgcaagcagcagcaacgcttttcgaatggtatctctggatgcttcatagattttcataagctcatattcaccgggaagcgtatctccggctgcatagagattctgttcaattcttcctaatatatccttgtaaatcgcttcgtatttcgacattgtcatcacctacttgattttatcatgtacgtacaaattcgtcaaagggaattctgttttcataaaatcaaatatcgtattcgcttcgtacggcttcatatatctgacgtgtaatctcgtcgaagcataccagataaacaatctttatacaggtttccttttcttccagtattgtccggatggcaatgcgggcagcctgttccaaggggaagtgatatacgccggtactaatggcaggaaaagcgatggaggttatatgatactccttcgccagcttcatacagcttcgatagcagctttccagcaactcgcattccccatgatttccaccctgccatatcggacccggtgtatgaattacataggaacaaggcagccggtatccctttgtgatttttgcttctcctgtcttgcacccgtgaagggtacggcactcttctaaaagctcaggtccggcagcgcgatgaattgctccgtcgacaccgcctcccccaagcagggaaacattggctgcattcacgatggcatccacctgcagggttgtaatgtcgcctgataaaatctttatcatcatatcattccctcactcatgaaatatcgtctgaatgaaatttttcggtccgtgtctatacagcagaacaatgccttctttgccaaggtcacgataaatatcatcaaaataaaacatgcctgcaacagaggggaactgattccagaattcctgtgtcacggcactgaccaggatcttatgctgtaaggcttttgtttccacctgcagcgcctgtgaaagaagaccgaaggcacgctccttatgcgcttcatatttctgtgtataaaacttatagctgctgcaggaagcattccatgccagataattcgcaagaccgtttgtgaatgccagatggtttaacaggctgagatatttacgggaacgcacagggaactgcttctgaatcagatactttgatagctcgaaggtcagataattctgcaaaatataggtcatctgtgaaacgatacgggtataatcagcaatatgaatcagatcaatcaggatacaaagcccttcctcagatttcacaatgcggttttcctttgtgccgacaaccgccatgatacagacagtcttcagctgctccctgtaattgggaaaaacagcctcaaaaagctctttattaaaggtcggaaattcttctacgatgctttccagctgcgagtccagctcctgtacgatatcccttcgtttcggatcagcctccttgtactcctgcagcaggtaaaaatgcttttcctctgttacaggtcttccttccagaaatgcggcagctatgcgattgtcatacagcataaaagacccctccttttgtaattcattatatcacgtttccatcacctgcgtgaatgttttgccatatcccttataagatgcacattccaggggaaagctaacagagaggatgtgattatatgagaaaagaagtatggcgtgatgtgattttaagcagtgtggcatttcttgcactgatgtgggttgcttttttctgggcccagaaatatttcccgatggagcaggatagtgctgcagtcgccaaggtggaagaaaaaaaggttgcgtatttaacctttgatgacggtcccagcaagcacacgcaggaggtactggatattctggatacctaccatgtcaaggctacgttttttgtgacgggaagcaatccggagtattacgacctgattaagaaagcggatgctaaggggcatgcgatcggtattcataccttctcccatgattatggcaaaatctattccagtgaggaggcgtattttgaggatgtcaataaaacgaatgcgctgattgaaaaacagacgggacataaggtgaatatcctgcgctttccaggaggcaccagcaatacggtatccagaaagtacagcagcggcattatgagtacgctggcagcttctgtaacgcaaaaagggtatgaatactatgactggaatgcttccaacggggatggaaactgttatgtaggcagtgattcactgatcaatacggcattaaaggaaatcagggataaaaaagaggtaatgattctgatgcatgatggaaccggaaacaaggcaacggtagaggcgcttcctacgattctgaaaagtatgctgtcgcagggttatgagtttcgtgtcattgactcttccacaccggtatttcatcatcatatcgcaaactgagaaagtatggtataatatttcatatgcagttgcttgacaggtgatgaaatatgaaaataacaagagaaaaaaatctggatgaaataaaaaacggatatacaaaggacaaacgtaatttttaccattgtaatttttgcgatgcagtgtttgaggatggtgaaatttttccgataaacgggcatttttaccgtgccgaaaaggcggtgcagatgcatatacaaaaggagcatggttctgtgtttgaacagctgctgcagctggataagaaatcctgcagtctgaccgatgtgcagaaaaagctcctgcagtatattcatgaagggaaaaccgataaggaaatagcctcgctgacaagtacaagtgcgtcaaccgtccgccatcagcgctttgttttccgagaaaaagcaagacaggcgaaaatgtatctggctctatatgagctatcggtggagggtatgatggataatctgctggaggtgcatgaccatgccgcacaggtggatgagcgctatgtcgcaaccagtgaggatgaggagcaggtgctgaagacgatgacactctctatcgatccgctgaaattaaagcagattccggctaaggaaaaaaagaaaatcatcatactacgaaaaatttgtgaatttctggagccgcatcaggtatacagcgaagaggaaatcaatgcctttttaaagcagatattcgaggattttgtatcactgcgccgctatctgattgagtacggctttttgcatcggacaaaggattgtcagttctattcaatggatctaggaaggatccgggaggtggaagaccatgaatgaaagcctgcactggtatgaaaatgaggatcaggtaaagcatgtctcgcgctgtatgcgaatgtatcctttctaagataacgatgaaaggaggagcatagaatgcaaagcatcgtacatgcttactggaatgcaatacatgagctgcgttttcaagatgtaagagagttgttctgtgatactgcagaaattacatggcccaatacggaggaagtctttacccttgatgaatttatagctgtaaatgaagcctatcccggagaatgggaggaagatgttctgaaatgctatgaaacaggggatatgattataagtgaaacaatggtgaagggacaggaagtatcctttcttgccattggtttcttcacaatacagggagggaaaatcactgccctgcgtgagtattggactgctgtggaagcagtcccggaatggagaaaagagctgttaaaaagcagatagggaatgcatacattccctgtctttttatctcaccattcacggagcttctgaccgccgttcgatacattgtaattgtttcagcagacggataaaattatcatataagtgttagatggtggatactatcatcataggtatggaagagcttctgctgttcgtcccattcggtggaagtatgcattgtaaaaggagctggtttcatgaagtttgcgacaagtcttaccagccttgcatgctggctcatggcaatcgtacccggtgtgtacctgctcgcctatctcagtgcccgataccttcatttgccatctgcatattattatacaatactggcgctggctgccaccggctacgcaatattcctgttcctggtgtatcggctgaaatgccgtattcacaattccgcgcgcagccgggatggggaaacctcggcagactgcatgaacagtgatcagtaggacgaaagggttattgagtaaataacctttttttctcgtctttttgtgatacaattacgtagtaaatggcaggtgtttttatgttgaatgatacaatagccgcaatctccacagcggcagtggatggggcaatctccatcatccgaatgagtggagcggatgccttgtcgattgcggacagcattctgaattttaatgtaggagagaaaaaaagccatacgatcagctatggctatgtttatgatcaggagcacgatgaactgattgatgaggtgcttgtcagtgtttttcgtgcaccgaagacctttacctgtgaggatatcgtagaaataaactgtcatggcggacggtttatcacaaagaaaattctgcggctgtgtcttgcgcatggcgcacgtcttgcgaatcccggtgaatttacacagcgtgctttcttaaacggccggattgatctgacgcaggcagaagctgtgaatgacatgatacaggcagataccgatgaaaatgcacgcatggctgtgcagggtattcgcggaagcgtcagaaagctgctggagcccctgattcaggatctgctggatattatcgcaaacattgaggtaaacatcgattatccggagtatgatgatgtggagcagctgagcagcgacatcattcagccaaaggctgaggagtggatgatgcgtatccggcaaattctggaccgtgcacagagcggtcagctgttgaaggagggcatcaaaacagcaattgtcggtaagccgaatgtcgggaaaagcagccttttgaatgcgctgcttgaggaagagaaggcgattgtgacagatatcgcaggaacaacacgcgatatagtggaaggacatatccatttgcagggactgactctgaatctgattgatacggcaggaatacgggatacagaggatgttgtggaacaaatcggtatccggcgaagcttacaggcaatttccgaggcacagcttgtaatcgtcgtactggacagcagccatgcactggatgcgcaggatgaggatctgctggagctgacgaaggataagacgcgtatcattgtatacaataaaaccgatatctcccatcgctgtgagggcatatgcatatccgcagtcagtggtgagattgagcctttgatggcaaagatacatgaactgttcgacagtcatcagctggtactgcaggagccgctgctgcaaaatgagcgccagatctctttaatgatgaaggcagagagctgtatgcggcaggcgcttgctgccatgaagtcgaaaatggagctggatatcgttgctatcgatatacaggaagcctatacagccttaaaggagatactcggggaagtccatcgtgaggatctactcgacaccttattctccaatttctgtctggggaaataagcaggagggaaaaatgttatgaatacattgatcgatacacattgtcatatcacctgtgatgccctgtatgagcgcattgacgaggtattggagaatgcaaggcaggcaggaatagaaaaaatgctcatcatctgtacggattttactgaatatgagcgtgcacagcagctaaaggagcgcgaaccggagcgctttgatatcgcactgggctttcatccgaacgatttgtacgcttttcaggaagccgattatgagcggctggaggagctgctgaaacaggagcgcattattgccgtcggtgaaatcggactggattatcattgggatgatgtaaagccgcaggaccagaagaccggctttatccggcagatcaggcttgcgcaaaaatataacaaaccgattcttattcatatgagagaggcaacgaaggatacgctggacattctgaaggatatgggtccgctgaaggggatcatgcattgctacagcggaagtaaggaagtggctatggagctgataaaaatcggtttttatatatcctttggcgggccgcttacatttaaaaactcaagaggggctccggctactgtagaagcgcttcctttgaaccggctgtttgtggaaactgacagtccctatctgacgccgcatccgttcaggggcaagcagaatgagccgatgtatgtcagatatacctttgacaagctgtgtgaaatcaaagcggtggagaaagatctggcggcagagcagctgcggaaaaattatgaggaattatttttaaaataagtataccggcagctgatggacatcttaaattgtaaaaaaagaaagtcacctatccaacagatggaaagagcggctgataaagaaaatgctgttatgtgcataagagaaaacctttcgcgcatgaggcatcctgcctgctgttgcttttgatagaagtattcaaaaaaggtagacgatttatagaagtcgtctaccttttcagcagtcatcaggtactggtaagcagggtacagcatgtattacatcaggattgccttgcctctgtatcaggtattgatatgtatgagacacactgcttgaatttgaaaatgcggatttgattcctgctacagcgctatttccaagcacagaattacacaactgcatgattagggaaaaacgctatgtaagtcttctgataaaggacttatccatggataagcatatgttatgaaaaaaaaagccttttttcaaaggcttatcagcagaaatggtcggaatgacaggatttgaacctgcgacctcttgctcccgaagcaagcgcactaccaagctgtgctacatcccgatgtcctatactattttattccgttttatgaaaatatgcaacaaaaaaagcgcattttcataaaaaagcgctatcttttgaaatttttgattttctggaaggtatcttcgctgatcacatgctcaatatgacaggcttcttcctctgctgtatccggtgcaacaccaagtacatcctccagaaaggaacgaatagtcgtatgacgctgatacaccttgacagccagctctcttccctccggagtaaaatgaatatccccataggtttcctgctgaacaagtcctttttcctttaatacattcatagccttattcacacttggcttggaaacatccattttttttgccacatccacacaacggatcttgccgttttcattatccaggatcagcagtgtttccagataatcctccaacgattcacctaatatcacctttatcacctcaatgccttttcatcaatataccacatatttgttattctgaacataaatttttatatttatcttccttgaagccgaccgcgattcctttttcacaaatcagcagcggacgcttgatcagcataccgttgccggcaagtaaattcagctgctcctcctcgctaagcgccttcaagcgatccttcagcttcagctccttgtaaacatttccggaggtattaaaaaatttttttaattccagtccactctgttttacccacgcacgaagctcctccacagtaggtgtttcttcaacgatatggcggatttccagctccattccggcatcctgcagatatttctttgctttcctgcatgttgagcaggttggatattcaataaacagcatacgcataatttcagtctcccatcttttttataatcataaccaagaatacatgaaattgcaaatacattgcctgtaggaagggtacaataagcaaatgtaatgaataattcctatatatatatcgggtagaaatgcaatctgctttcgataaacatgcaaaggatttcatacatcatgaattgcggcatgtttttggtaaagcatgcctacatccgtttccagccatcgtataaacattcataaggtgatatcccggttcctgttaaaagccggtaacaaaaaaagggtactgtgatgtcaatgtcattaagttaagaggatgaaaacaaacaggatgcggttttattttatctcattctgataggattaagagtattctgaaaaaaatgcatgacaaaaagaagatttttcaagcaatttataaacttttgagttataactatatcgtattaagaaaagcggtagttgaaacatactagcgtttgtgatttcataagcctcttacattttcgattttggcggattggtaagatatcttgtgaaatgagagtttcaagatcaggcgggtgaccgccttttcttttataatgctggataaaatagcgacaatgatgtatcgccattttttttgtttatcgcataagaatacttttttttcttaccctttccctttggctttttatttattatatgatgagccataataaaagatatattatacagtatcatccttgcccaaatctcctgttggatgctttctcgttttttcgcatgaacagcacacagatccgctgaatatttaaggtcacggaacgataattctataccccatcgagtattgtatatttcttttatttcatccttactaaattcatcccggcttaaatttgtgatgatggattcatattcttcactaccatccagcttaaatcgaactacacggaaatgaagtacatactcaggattatgttcatcaataaaatcaaacgtagatgtagtagataagaaacgatatttctctggttgagattttatatctttggtctgttttcttgtcaatgtgatatgtaaatccaaatcaaattcttcatctggcagattgaattttcttaaaagactggaaatcgagtgtatatctttcacacgtatcaaaaaggacttacccgactgtatgatatgtgccatagtattccaggttgcataatttctatctgcgataaaaatagcattatcatcgtgaaaacgttcaactattttccacatggcttcgacctcgttcttactatgaatcccttgaacgatcgtatctaaataacgatggtttaaaacatcatagctgacattaagatgaaaagcagatagaaattttcctttcgatgcacttttatgtaacgtatcgggatcactaaaatcaagtggtatttgcatttcagacccatcgaccgcaataagatgatagcccttatataaattatcaggtggaaatgctttattcagttcattcaaaatatattgaaaaacacgtgaagaaattttagaacgtgcctggacaagtgcagaggcagttgggggattatttgagtaatggaaaaaatcaagtagttcttcccggataggcttacccgccattgataagatgaatgaaatagtatctttaaaagatagctttctagatttacgagtgaaatcagaactttcatgtgtgacaaaatgttgatcatatttcaaacgatccgccttatttaaaatcttatccaaagaattgaaaagtgttttatggatagagatcataccacaatcccctcaattcttttatcagatatgaaggtagaacaagcattgaaattattactaaggatcatataagatcacctcctataccttacaaaagcgcgaagtgtaacggagcgcacgatttttctgattttgtcaagcctaaataaaaaagacacctatactttttgtataaatgtctctcatctatttttctttaacttaatgacattgactgtgatgtacccaataaatttactgattgaagtaaaagccgtcgaaggtgtatttataaacccggtaaatatacttttcaccctccatggtaaaggaacgaatcagcgtatggtcactgtcatattcctggaaattaaatgccataccactgtccacaacagtattgccaccgatattctgcacgctggatacatagggagaatacggaacatcaaatgtatccacaagctcataggtgcccttgctttcatctaccagatatttgtaatatttgctaacagcatcctctgccttcacctcggtagggatattcagctgactccagtcataggctgtattcgtggaagagtatccgaaattattattgaacatatacagataatactgaccatcagccagagaatcgtcttccacataggttatggaatgctgtccggtctgtgaggtgaagctgtttgccttatccagcagcaggtctgcatagtcactgtcttcccaataggtcttttctcccatcatataatctatttccggtgtaccatagatatccgtgattttgacgatggtgctagtttcccggctgctcacaagaatttcattatttcccatccactgaatggtattcaggtgtgtccaatccagctcgtcgttgtctttgtcatatactgaggccttataggtaggaaacaaatcccccatatccacgacctgagacacggcaccgctggaaacatcaaggcggataatcatatcctcaaccgtatcctttgtcgtatcggtcgcaagaatcagcatatctccattatcatcaaagacgtaatcatggtgcagatcatagtttcccagatcaaatacattggttatctgtcccagtgcatccatctcagccatcttatttgtactgatactgtaatacatgcgttcattcgcaaacagcagacggtgtgagcgatagccttcaattggaacctcaccgcgcaggataccgttgttatcataataatacatgaagtcatcctcatcactgtcattaccgagaataacatacagaccatcgctgagctcttctctgctgctaccttcctttgcttccagctgaatggattcgtttcctcttagggagccgcaggtataggtatatgtgacatccttattcgtaccgtcttcatattccatatgcagggtaatcgtattctcgtgatccggtatcagaccaatcagctgatattcgtgtgttcgtgtataatcactgttcaatgtgcgtgtgaaatccgcaatcttatcatcctccacatggatcgtgtagctgattttcgccccctgtgcagttgtgaaataagtatacatggaaagtgtgtttgtaccaaacggattatagaccatcaaagcattgttttcgctgtggctcccctgtgcaatctgttcatccagagttttacgaatggtattctgcttttccacattataaatttcctttactgctgtctttccggaaacaatactgccaatcgtatttgtcgtatttggcttggacagccaggccaccagacatagagataccgttgcaatcgttaaaatcatagcacttcttttctttttgttcatttttatcaccacagctattgtatcaatgctctgtgaagtttttctgaagcagctgtgaacgcttttcaaaaataagggcaataccatgtgaatcctgctgcagttaaaaagacagtccgaagggactgtccatattatctgtggtatagctttttcgtctgatatctgtcttcgcatgtcagattgacattcagcttgcggaaggtattcgcatccacctgggacagaattaccgtgctgtgtgcttcacagtccttcagcttatccagctgctgcagggctagatgtgataccggattggtggttgcactgatggatagcgcaatcagaatttcatccgtatgcagtctcgggttatgatttcccagagaattcaccttcagcttctgaatcggctcgatgatgtttggtgaaatcagcggaatttcatcgttaatattacccagtgccttcaatgcattcagcaaagcggcagagcttgcccccagcaatgaggttgtttttcctgttacgatccgcccatccggcaattcgattgccacagccggtgcctctgtttcttcagatttatccagtgcgggtttcacaacatttcgctcctcaggctgaatgttcgcctgtgacatgatgatttcgatcttaccgatggtatcttcactcgtatgtccttttttataatctactctggctttataatagcggcgtatgatctcatcgctgctggcacgctttgcggcctcatcattcataatgcagtagcctgccatattcacacccatatccgttggagatttataagggcttgttccaaggattttctcaaacatggcattcagaaccgggaaaatttctacatcacggttatagttgacagtcgtttccccatatgcctccaggtggaacgggtcgatcatattgatatcgtttaaatccgcggttgcagcctcataagccagattcaccggatgcttcagcggaaggttccagatcgggaaggtttcaaatttcgcatatcccgccttgatcccgcttttgtgctcatgatagagctgagacaggcaggttgccattttaccggagccgggtcccggtgccgttacaacgatcaacggctttgttgtttctatgtattcattcttgccgtagccttcatcggatacgatcaaaggtatattgttcggataccctgcgattggataatgcagataaacatggacacccagatgctccagatgtgctttaaaggtatctgcggaagcctgattcgcatattgtgtgatgacaacactgccgacgtacagcccggtatcacggaatgcatcaatcagacgcagcacctcaacatcataggtgatgcccatatcgcttcgtatcttgtttttctctatatcatttgcggataccgcaatgacgatttccacttcctctttcagctcaaggagcatttccagtttactatccggctgaaatcccggcagaactctggcagcatggtgatcatcaaacagctttccgccaaactccagatataatttattgtcaaaattgctgatccgttccaagatgtgcttggattgcagttttaaatacttgtcattatcaaatgccacttctttcatcgttccactccttttcaacccactatttcgtattataccaaaaaagacatgcatttactaattaaatgggaaaaaatcgggaatattttatgatgtacagcggattcatatgcaggaaatgacaagttcttaagatttttctttttatatagatatctgtcctgaaatgctttataataataatgcacttttgcgcctgtaaagaatcacgtgaacagtaaatcacaataaaatagtaatactggaaggagaattgtcatggaagaagttataaagattgaaggaaagcatgcattagaggggacagttagaatcagtggttcgaaaaatgccacggttgcactgatcccggccgccattctggcaaatggaccagttactatttgtggagttcctgaaatatctgatgtacaatccctgtctgtactgctgagagatctgggtgttctggtggacatccgttcttctgataccattgttatagatccaacttcaatggaaaatcgtcctctggtacaggacgctgtaaataaacttcgcgcttcctattatttcatgggagcactgctgggcaaatacggccatgtggaaattaaaatgccgggaggctgctatctgggacccagaccgattgatttgcatttaaagggctttgaagcattaggagctgaaatacgctatgaccacggctcctatattctggatgcaccacagctgacaggaaccaagatatttctggatatcgccagtgtgggagcgaccatcaatattatgatggctgccgttcatgcaaagggaagaacaacgattgagaatgccgccaaggaaccggagattattgatgtggcaacactgctgaataaaatgggtgccaatatccgtggtgccggtacaaatgttattacgattgacggtgtggatcagctggccggatgctttcatgaaatcatcccggacagaattgaggctgccacgtatatcgtgcttgccgccgcagccgcaaaggaggtacgtatcgacaatattattccgcatcatctggaggcactgctttccaagctgaaggaaatcggtacagatttggaaatcggtgtggataatgtggtgattcgcgcttccagggacttaaaggctgcggatatcaagacactgccatatccgggctttgcgacagacattcagcagccgctgacagcactgctgacgcaggcacagggacagtcgattgtaacggaaacgatttatacagaacggtttaagcattgtcaggaattaaataagatgggggcaaacatcaatgtaatgataccgagctcctttatcaatgggccaacaccgttatccggtgccgaggtctatgcgacagatttaagatgcggtgcctgtcttgtgattgcaggactgatcgcagatggtgtgacaaccatacacaacatctatcatattgaacgcggatatgagcatatcgatgaaaagcttacagctctcggcgcaaaaatatggagagaaacagtagaataagcaaagagaagaacggctggtaacggcggttcttttttcgattcctgaattaccgcaggcagtggtgcttccgtttattcattctgccggatatggaagtttctattctgcgaaaatgagacgagaaatgttaaagggttaggcaaccagccttcactgcgcatagaaaaaaatcgcaggcagaccttcgaatatgatatactgtccttaatacagggtcttgtttcctgtgaaatatggcagataggagaatgtatatgaaattaagagaacatctgtatctactttccggaggtgtatatggcaagctgggaaatgtctatgcccttcagcatgacagcggttatattctgattgactgcggacgatatgatgcactggatatcatacggcagaatatggcttactggaatatatccgaacacaaaatcacgcatgttcttttgacgcacggtcatgatgatcatgcgggcagttcttcctggtttcaaagcatgggggcacaaatttatgtagggacgggtgatgaaatgaatatgatcaccggaaatttcggcccggaaagcccatttaccaaccatgtgatgccaccgtgtcatccggatgtatgtattcacgaggatatggatatttccgtaggaggtctgtgtatccatgcactgcgcatgccgggacataccagcggctccatgctttattatgtaatgctggataaggaggcagtgcttttcagcggtgacatgttttttgcggatggagaaaccggtgaagcagcctataccggatggaaaggcgatatggcatatgacggcttacgtttgctggaaagctttcaaaagctctggcggcttcagctgcatccggatatggtagccggtggacacggtataccggtgatcggcagccatgcagatcagataattatgctggcatataaatacgcaatgctgaacaaccgctagtttccatatactctttcctataaacggcgtataataaagctgtataaaaggaggagaaacaaatgaaaagaatgattgtgaatgcggatgatttcggcttcagtgaggcggtaaatcatggcatattaaaggctatgcaggagggaattgtcacatcgacttcaattatggcgaatatgcccggctttgcccatgcagttcagctgtatcacgagcatccggatatggctgtgggtgttcatctgaatcttacctgttatcgtccgctgctatccacacatcaaaccctggttacggaaaccggctatttccacaaacaggatgatgttgcaggttatagtgaatcggaaatgtatgaagaattaaaggcacagatagctgtgttcttgcgcatggtattcggattgatcatctggattctcatcaccacattcatacaactcaaaagctgcagaaggtgatggaaagactgaataaggaatatgcattgccatttcgcggcggctttgcatatcccgtatcctttccgcatgcgcagctttgcatggatttctatgattccggagtatccctatcagctttggaggctgtttgcgctaacatttcagatcacgaggtgacggatttgatgtgtcatcccgcctatattgatcagtttctgtatgaaacaacctcatattcatggaagcgcatgaaggagctggaaatcctgtgcagtgaagaagcggctgctctgcttcagcgatatcagatacaattgtgtacctataaggaagtataaaacataacgacacgggggtgatgcttatgctgagaatagcgatattggaaaatgaagaggctgcgaaaaacatcatgttttctcttgcacagtacctgcaggaggaggactgctgcttctactgctttaaaaagatatcccagttcgcaaaagcggaggcggagaaggaatttcatgtcgtaatttttcatgaaaaaatggaagttcccagaataacacaatcctttgttttacgtaagcctcagcgtatcatcatctatacaaagacgaaaatcagtgcatctgaacagcagattcttccgttttcacgtatattttatgtggaacgcaaacatctccaatcagagatggagagaattcttcctcatatgcaaaagcttctccgcaatcaggatgagtatttgttctcttataacaatgtaaaggtgccattgaaaatcagcgatatttattatattgagaaagaaggaaagctgcttgtatatcatacacggcgcggcgaattccgtgaacgtaagaatatgaaggatgcctatgaaatctttaaaccgtataactttctctggattcatgtcagctatctggtaaatattatgtatattatgaaaattgagaatgatatggtcatgctgccatcgttgcatctgcccatttccagatcgaagaaagcagaggtattaagcgccttccatagcttaatagagtaagatcacaaaattccatttacctgtaaattattccaaaaaaatttacatatatgcgatgttgtatataataaacgtgtaaacggcattacaaaagaaagagagcggtgaaaagatgggaaagttagcagttaactataacggagtatcttctgcgcaatttgtttctattgatgtaaaatcgacctattggcctggtagtggttcaattcaaatggtactatgagaaagaagtcaattattcttttcatcttattactttgtatggcttttggtgttgtttgctatgtaatgtggatgagaggtatagaagaagctattcatttcattaaggaagatagcccaagagaaatactttggggagagtcactggccgagaaagattttgtagaattagattcttctgccagggatgcgactgtcctgtttcattatgatgattccattatcaataaagaacagttgcttacggtaacagttagctgcaatgggtataagacaagccgggctttcaatttgacaattgttgacagggatcctccaattataaaatatacgggaccagtgaaaatagaaagtgatcccaacgttagattaagtgattacctgaaggtttatgatgttcgaccctatgataaggtggtgtttgatttgcaggaaaaagatggggataaagcataccgctattatgaatatacctgtgatgaaaataaccagacctgtagttttgatgaggatgctgttggcgttcatactgttcatatatctgcgtatgacgggcatgggaatcaggcatataaaacaataaagattatcgttacatcccctgcctatcattgaaaatttggactctaatattgcttggggattctagtagaaatgagattatgggaagtataacgtaggtaaattaccaattattccaaatttctgcaaattattccacaaccctttacagcagctgttcagcgaatataataaaggtgtaaaagaaataacaaagaaaagagagcggtgagaaaatgggacagttagctagttagattattctggaacttgtcattagaagctgatgcgtgaaagggtttcttgtataggagcttgtcagtgaaaagaaagttattcgaatatcataataatctaacgtaaaacggaaatacggtgtggatcatcgaaagtttaagcctgaagaagaactggtgacagcagacaaggtatcaggaaatgatatgagtgattgtatcaactggtaaaacagaaaactccaaggtaatttgaatgttaatacaagtagacaaatcgaacggctgttgaatatcgatggttaagtaaatagatctatatcttatgaccggctggactatgatttgatgggaaagcaagcgtttaaggagaaactgatgagaaacgaaacatgagaattgttgtccgttacaaagatcaggatgtgtatccggttaacaaaaagatgtcataagaaacctgaaactatctaaactgatgagattggaaggatatcataagaaccatcacttccggcaaagtcaggaaaaaatatagaaagcatcaggaggaatgcagattacgtaagaagcagggataaagcaaatcagcaacctgcaacagatatggttaaaagaaaatactgcagattccattaatagttcaaatacgaagcgttcattgaaagcttgtcatgatgtattgtaatttgatttgaatcctaagatttgtatcttatacaaagacatagataagaagaaatggatgtgataaaatacaagtaaatgataaagcctctggcacatgtgaaatgctgtcagaggtttttttaatgcttcacttatccacttgaatcacagtgctgttggagttctcacaagatatggactgttgctgtatgaacttcattcatatcatatgctatggataacccgtagctatttcaaagaaagaccttttattacctacatgttgcagtaagacaatagcctacaggttcaatatatctgtttttctccctgttataaagcgattacatattacgagctgctctatgtggaaaattcacaaacaaaatgtttagttagagagtgttctttgatataatagtaggtgctggagggatactatgtccaatatatttcataaagaagacttttccaaggtgcttgcaaagcacggtatgatattgcaggagcatcagcttcggcagtttgaagagtacgcatccatgttgatcgaatggaatcagaagataaatctaaccgccataaccgatccggatgagatttatgaaaagcattttctggattccatattgccttcctttgatatgtcgatacagggcagcttctgtgatgtcggggcgggggcaggttttccgggaatacctttaaaaatcatatatcccgagctggagctgacaattgtggagactctgggaaaaagaattacttttttaaatgcattatgcgataagctgcagctcaagggcgttacctgtgtacatgaacgcgctgaggtctatgcaaaggaccatcgggaaagctttgatatcgtcagtgcaagagccgtggcgaatctgccgctactaagtgagctttgcataccgctggtgaagaagcagggcagcttcctcgcactaaagggtgccaatggggatgaagaatacgcattggctgaaaaagcaattcgacttctgggttgtgaaatgaagcagagggatgtgcatacattgtcagatggatcacagcggattaatttcgtttttgtaaaaacgagaccgacaccgaagaaatatccgagaccgtttgcacagatgaagaaaaatcccctttgaggaggaatagaatgaaagatacaagaattgtggatattgatctggtcgagccgaatccttatcagccgcgtctggaatttgatgatgaagcgctgatggatctggcacaatccattcgtgaaaacgggctgattcagccaatcacggttcgcgagatggatggaagatatcagataattgcaggtgagcgaagattccgtgcactgaagctgaacggtgctgttgatgtaccagttctgatcatggatgccaatgaagtgcaaatggcggaaatggcactggttgaaaatatccagagagagaatttgagtgcgattgaagaagcgaaatcctatgtggagatcatgaaatattccggactgaatcagagtcagctggcattgcgtgtcggcaagagtcagtcgtctattgcgaataaaatccgtctgttgaatctggatgaggatgtgcaggaggctgtcagtactaaaaaaatcagtgaacggcatgcacgggcactgattgggctggatgaagaaaaacagcacgatgccctcgaaaaaattgtgaaaaagggcatgacggttgcacagacggaaaaaatgctgaaggaacaggcacaaccgaaaaaagaaaagaaaaaagtgatgctgaagggtatcagcaagaatattaaaatcgcgatcaatacgatccatcaggcgatcagtatggtgaatcgcgccggtacagcggcagaaataaacgaagaggaacatgaggatgaagtaatcattaccattcgcattccaaaatagaaaggaaatgatcttatgggtaaaatcatagcggtatccaaccagaagggcggcgtaggtaagacgacgacatcaattaaccttgctgcaggcttgggataccttggcaataaagtgcttctggtcgattttgacccccagggaaatgccactcagggtgtcggtgcagaggtcggtgaggataagctttctgtttataatctgattatggaggattacaaggtggaggatatccggaagaagctgacatctccaccaatcgatattgttcctgcaagtattgcactggcgggagccgatttgcaaatggtaaaatttgaagtaggaaaagaagagctgctaaagaataagctggagctgatcaaggatgaatatgactttatcatcattgactgtccgccttctttgggactgttgaatacaaatgctttaactgcagcggattctgtaattataccggtacagtgtgagtattatgcactggagggagttacacagctgcttttgaccattcgtctggtacagcagctcttcaatcgcaatttaatgattgagggtgttgtgcttacaatgtatgatgcgcgaacaaagctgagcgttgaggtacagcaggaggtacgtcagcactttaaggatcgcgtttataagaattacataccgagaaatgtcaagctgagtgaagcaccgtccagaggaatgtcgatttttgaatacgatgtccgctgtgaaggcgcaaaagcatatgcagggctgtcgaatgaagttgtgaaaatgaataagaaagcaaaagccagatagggaggtggatgaatgccgaaaaaagagaatagcgcaagacttggaaaaggattgtctgccatttttggtgaagatgtcggtaatgtgctggaggatattcagcagggaaagactgaggttcatgaggactccaaatttgaggttgaggtaaaggatgtaaaaccgaatccgtatcagccgcgaaaaaactttgatgatgacaagattcaggagctggctgattccattaagctgcatggtgtttttacaccaattctggttaagaaagccgttaagggctatgaactgattgccggagaacgccgattgcgggccagcaaggttgccggattaaaaaccatccctgctattctaatggaatttgatgatcagcagatgatggaaatcgcactgctggaaaatattcagcgtgaggatctgaatgccattgaggaagcacagggctatgaaaagctgatcaagaagcttggctatacacaggaagagctggcgaagcggattggaaagtcaagagagcatgtggcgaatatgctgcggctgttaaagcttccaaaatcggtacagcagtatgttatcgacaagcagctgagtatgggacatgtgcgtgcactgcttggtttaaaggatgcatcacaaattgaggatgtggcaaaaaaagccattcagcttcatctgagtgtgcgtgctgtggaaacattggttaaaaatatgaatgaaccgaaaagcgcaccggagaagaagcagcgggatatcaatctggataaggtacaggatcgtctgcagagtcgtttccaaacaagggtgcgcattgatgagaagcagattactatacgctatgatggcaatgaagatttaaaccgcctgctggaaatgctgggcggcattgaggaagaataaagaaaaaacaaaagccaactgcttcgatttcattttaggcagtatcaaaaacgaaatacggaaaaagagcaggctctttcagatgcttctttctcgattgtgggtaaacataaaacagggagaatgcaacactattgtatttatcaatagaagttgtattctcccttttgcatacaccttaaagaaagaaccttttaaattactcgattttttttatttatgagcctttctatgcagatgaagtccttttctgcattttttattttcgtatgaattatgtgtattacaaacagtcattatttatacaaatcatcagacatgtgtcttgtcacctgtcattatatatgctatactgaggcagatacaacggtatagagaaagggagatgaagatactgcataaatattagcggtatcatcaaaggatatgacaaaacaggaagaaattaaacagctgaagcttgaaaaggatgccgtattgctggcacattactacgtacctgcagaggtacaggagattgcagactatgtaggagattccttctatctgagtaaggtggcgtccaaactgacgaataaggtgttggttttttgcggagtttccttcatgggagagagtggaaagctattaaatccggacaaagcagtgctgatgccggatgcatctgctgactgtccgatggcacatatggtaacaaaagcagagattgatgacgtaagggcacgctatgaggaccttgcagttgtatgctatatcaactcgactgctgagatcaaatcatggtcagatgtatgcgtcacctcagcgaatgcagtgcagattgtgaagaagctgcccaatcagaatattttatttatcccggataaaaatctgggacgttatgtagcagagcaggttccggaaaagaatgtcatgctggtaaagggatactgtccggttcatgaggaaatgaaggtaaaggaaatccaggagctgaagcagctgcatccgcttgcggaagtgcttgctcatccggagtgtaatgcctctgtgctttcgattgcagattatatcggttcaacaaccgggattttgaagcaggctgctgcaagcaatgcaaaggagtttatcattgctacggagattggtgtccgctatgagcttgaaaagcagaatcctaagaagacattttactttccgaaaacagagccggtatgcatggatatgaaaaagattacactggacggtattctgcatgtcctgcgcactggagaaaatggtgcagctgtagcttcaaatatcgctgagccatcaaaggcaaccctgaacagaatgctggagcttgcggcgtaaaccgccttaaggaggcgaattatgcaatcagatatgtattatgatgccgtcattgcagggtgtggagttgctggtctttatacagctttaaatctgccggataccatgcgaatactgatggtgtgtaagggggatatggaggaatgtgattccatgctggcacaggggggaatctgtgtgcttcctgatgaagaagattatacttcctattttgaagataccatgcgtgcaggccactatgaaaataacagagagagtgttgacatcatgattcggcagagtagaccaattatagaagaactgcttcggctgggtgtccgctttgaacaaaatgaggatggaagtttgcgatatgcccgtgagggaggacattcccgtgcgagaatctgctttcataaggatattactggaaaagaaataacgacggctctgcagaagcatgtgcgaagctgttcgaatataactgttatggagcatgcccggatgtgtgatctgcttgttgagcatggtgtctgcaaggggattgcactggaaaccaaagagcagcaggttgttcatgttcatgcagaggatacggtgcttgcgacaggaggtatcggtggtttgtatgagcattccaccaattatccaagtcttacaggagacgccttgcgcatttgtaaaaagcatgggattcagctggatcatctggattacgtgcagattcatccgaccagcctgtacagccgtaaaaagggaagaagctttttgatttccgagtctgccagaggagatggggcgattttactgaataaaaaaggggaacgcttcgtaaatgagctgctgccgagagatgtcgtatctcaggctatttttgaggaaatgaagaaggacggcaccgagcatgtctggctgtcctttcaaaatgtaccgaaagagaccatacaaagtcattttccaaatattcaggaggcctgccgtaaggaaggctatgatattacaaaggaaagtatcccggtcgttcctgcgcagcattattttatgggaggaatccatgtgggaagtcattcagagacaaccatgcagcatctgtatgctgtaggagaaaccagctgtaacggtgtgcatggtaagaatcgccttgccagcaacagtctgctggagagtcttgtttttgcgaaaagagcagctgataacataacagtctgccggaaaggaaaaaaagcatatgaatccaattacgatgcagcttgttgctgataaatatatccgtcttgctttagaggaggacattaacggtgaggatgtaacaacctgctccgttatgcctgattataaggaaggagaggttcagcttatttgcaaggaagacggcatcattgccggtcttcagattttcgagcgtgtatttacgctgcttgatccgcaaacacaggttgatttccttgttaaagatggagataaggtcacaaacggtcagctgatggggaaggtgcacggggatattcgtgttctgttatcgggtgagcggactgcgttgaattatttacagagaatgagtggaattgccacatataccagaaacgtagcggatatgctggaaggctctaaaacctgtctggtagacactagaaaaacaacaccgtgcatgcgggtgtttgagaaatatgctgttcttgtcggaggcggaaaaaatcatcgctataatttatccgacggggtgctgttgaaggataatcatatcgatgcggcaggcggtgtaaagcaggcaattgaggccgcaagaaggcatgcgccgtttgtccgtaaaatcgaagtcgaaacagagaatcttgacatggtgaaggaagcagtggaggccggtgcagatattatcatgctggacaatatgacccctgcccagatgaaggaggctgtacagctgattgacggacgtgcagaaacggaatgctccggtaatatcacaaaagaaaacattgagctgatgaaggatctcggtgtgaattatgtatccagtggagcattgacacattccgctccgattctggatatcagcctgaagcatttgagcgtccttggtgagtaaagagaaaatcatatggataagaaagtagcagacagccctatggctacagctttgacaggctctcagcgcagaaaacgtattctgaccatgatgaggcagtcttcccgtccactctccggcggtgcactgggaagagataccggtgtcagccgtcaggttgtggtacaggatattgctctgctgcgtacggagggatatccgatcattgccactgcacggggctatatattgaatgaaacaaaaaaagcagttcgcctgtttaaggtctgtcacacaacagagcagatcagtgaagagctggaaacgattgttgatcttggaggaagcgtggaggatgtgatggtgaatcacagagcctatggaaaaatgtcggcgcctctgcgtatccgaaaccgccgggatgtggcagttttactggaaaatctaaagacaggtaaatcaactccactgatgaatgtgaccgcaggttatcactttcatcatgtaacagcggattcacaggaaatactggatgaaattgaagagcatctccgtcagaagcatctgcttgcggaatttctgccttatgagctggaggaggaaagcattccggatataaaataaacaaaggctgtattctggcctttgttttctctgtaggaagagactatttgaaacttatttcagttcttcagtatctcttttcgtataaaatcaacagtagcgtccgtaccatgatcacgctgatattccagaatcatcttcagcattgcctttgtctcttcatgcatgataacattgtcatagccgttcatgaagtattcgtacgcacttccgtcatgataattttccttcatatagatgcgggaagcggctgtccggtcgcagtacatttccacaatataatgaagcggcattttcaccggacggataccgcctacggtattatccagccagtattcccagtgatgcttgttgcggcctttatgatgcagccagcctaaggaatagccttttacttccttttcataatcaatgggactgcgatttccctggaaatacttgacacctgcacaaaattcaacaggagtgtatttggatagatcatgcagaagtccctgtttatataaaccacagcgaaaacacagctttgtgaccgcaagcttgtgtgcagttattgttttaaaatgtccccacagcttattcataatctgcactcctttcacattccagtctattttaccacgataggaattgttcagacaattcttttccctagtttatgaagcttcccgatttacgaatggaagtattgcttatttcttttccttttcatataacgttcacgtagtgttcacaaaggggatgtatgatatagacacaagcaaagcaatgcttgtgaaatcttaataaaggtaatggaatgtttccccatccctataaaaaaacaaacagctatcatgtttacaatattttttcatttccattacctgccttcatgctgaacctctgtccctcgcagaggttcttttattcgcaagattttacatgaaagctttttcttaagctttaccggcaataaaacaacagcttatgcgggagctgctgttaatgactcacttaaattacatgcgataatacgatttgcagctactgtgtgaagtgtttgcatttgaaaatcatattctctgcatttctgtatccgtttttcgtataaaaatacgagtgcatctcatcatttacgctgagcagctcgatgaaggaagcaccgttctcttttacggttttctccatttcatttagaaaatgcgtgccaagatgtgttccttgaaattgtctggcaatcacgatttcttccagataatatccggtcaaatcatcaaattctttgaaatatcccatgacgaatccgctgatagcatgatcagccatctgtataaaacacagcgcatcctctatcgtcatgagctgatggagtcttttgtatgctttatcataagtccagcagcctccttcataggtattataatagtctatgtacagctttaccactgcatctaaatgcggactctccattcttttgtagcgtatattcatcattgtctcacctgtcattttctgtaaaatatatgcttatcttttttgacagcatactgtaaataatatccgattataaaggatatacataggggtcctcctttgccgttctataacatcattatacagatattgtatgaatattcaaacatacttcacttgctgttcacacgcagggtgtatgctgtatatacagacagtcttgtctgaaagaagggtaatgacaatttcctattcatccatatgttatccatcgtcattgccgcaaagcctctgtcctgtcacagaggttttttttgaggtgttttaaaagtatatatgttttataataaaaatatatatttatgttgcagattgagaattttgagttataatataatcatcggaggtgtgctatgataccgaaatatatgcaggtatatacagagataaaggatgcgattcagaagggaagctatagcgcaaacgaaatgctgccaagcggagaggaattcgcaaagcagtatgcatgcagtgtgctaacggttaaaaaggcgctggatcgtcttgtcagtgagggtgtgattgtaagaaaaagaggtctgggaagcttcgtaaagaaatgcagaacaggtccggacagaatgcagggggtagctgttatcgggcgggatctgattcgtgaggaggttacctctgttgttgaaaagtttgaagtagcggcatgcacgacagagctggcggataaaatgaatatacaagccggagagtttgtgtatgagatagagcgcattcgcttgtataagcaggagccaagagttgtagaatatacatggatgccgctgcagatcataccgggacttcagcgcagggatgtggaaacctctatctatgcgtatattgaaaaacagcttcacaagcatatacaaggagcacatctgtcatttcaggctgttcgtccgcaggcactggaaaagaaatattttcacatgaatgacaatgattttgtatgtcaggtggaagagctcgcatatctggatacatctgagatatttgagtattccgtcgcacggcatcttccacagtattttcactttgaaaccaatgtaataaaggaactgtatgataactgaaccaatgttgaatactcgcatacagcgggagaatggaggatacaatgtattttgaaaaaacagcaggatttccagatgatttcttatggggcagtgcatccgctgcctaccagattgaaggcgcggatcgtgaagacggcaagggcatttcaaactgggatgagtttgtgaagatacccgggaaaacctttaaaggcactactggtgcagtcgcagtcgatttttatcatcattataaagaagatattgcacgaatggctgaaatgggattaaagacctatcggttttctattgcgtggacaagaatatatccccagggaaatggaaaagtaaatgaagcaggtttggctttttacgataatgttatcaatgaatgcttaaaatatggaattgagcctatggttaccatctatcactgggacatgccgcaggcgctggaagaggcatatcatggttgggagaatccacagattatagaggactttgtaacatatgccgttactttgtttgaacggtatggagatcgtgtaaaatactggataaccatgaacgaacagaatattttcacctctatgggctggatggaaggacttcatccaccgggaaaaacagatcagctgaagctgttctatcaggtaaatcatcatgcgaatgttgcacatgcacggagtgttttggaattgaagaaacgttttcctcatgcgatggtgggcgcaagctttgcgttttctccatgctatgcgattgattgccgtccggaaaatgcgatggcaaaagaagactttgatgatttacgaaattactggtggctggatatctatggttatggccgttatccaaagagtgctatgaaatatctgaggtctattgactgcgcaccggatattacagaggatgaaatgcgggatatccgtcaggctgcgtctttgattgattttatgggtgtcaattactatcagacagcggttgccgagtataatgatattcatggtgttggcgctaatcacgaggtgaatacaacaggagaaaagggaacagcaaaaatcagcggagtacccggattgtataaaaatccagccaatccgtatttgaagacaacggattgggattggacaatcgatccaatgggtatccgtatgtgctgcaggacaataacctcacgttatgatttacctatcattatatctgagaacggtcttggagcgtttgataagctggaagaagataaaacgatacacgatccttatcgtatagaatatcttcgtgcacatatcgaggaattgaaaaaggcggttgctgatggctgcgaggtactggcatactgtacatggtcctgcacggatttgttaagctggctgaacggatatcagaagcgctacggatttatttatgtggagcgggaagaggatgatgccagtgcagccttgaacaggtatccaaaggactcttttcactggtatgctgaggtgataaaaacaaacgggcagaatttgtaaagtgtataacgtgagcagattgataaatatggaaaatcagaagtatagtgctcatgatttcccatttcaggtataagaggatatatacgaaagtggaaaagtaaaggaacactatgcagacataatcagaaatcaaattaaaatgcagaacccggaaggtacggttaccatataccggcgattgttgagatatggatgcttctactttatggttctctgcatcagaagacctatgacttctgcacagttgctgaccaggatttgattgaaatggcaaaacgtttagaacggtgtagtaatccaatcataaatccaaagctgtaggatactcttaaagctgaagatatcgcagctatggataaaaataagatatgtgaaggatctgtaacaatggcatttcgactgctcatcagaatacacgaaagtatggatttttgggaaaagaaactggggagtaatggatatttgaattatttatcaaatgtagaagcgtttgagtaaagaacgaaaaagcatggtgtacataagatacgccatgcttttttgtaagaatgcagaagcttcagataagctttaacagtccttatttgctgcaacgaaagctggtaatgatttcatgaattttagctgcattggctgcaatatcttcactgcttccttttgtcagaagtcctccgaacccgcagacatccacaccgttttccagccatgttgtcagattgtcaagattgattcccccgcttgccagaatcggcatatccggaatcggtgttttaaaaacctttacaagctttggaccatagaaatcggaaataggaaatgccttgacgaatgccgctccgctgcttagcgcatcaacacattcggtaatggtggtacatcccggtgcatagggaatctggtagcgattgcacatttttgcgacctcttcattatagttcggggcaatgataaaagcagcaccatgcaggattgcgtgtcgtgctgtttctgcgtccagaactgttccggcacctacgcagagtgcatctccatatttttcagaaagaccctgtatgatatctccggcgttatttaacgtatagctcatttccatgacaggtacgccgcccttcatgcagccctcggctatttcacatgcgcgatccagtgtttccgcacgaacgattgcaagtgcacctgcctcatacatacggtttgtgacgttcatttttttcatattcataatgacatcctccttgcctatatcttacgttgttttagaaacgcttacaattggatgagtgaacaaaattagagatgaaatatgtgcgcttaaacaaatgagatagcagctgaaaagatattgtacatccggttggcttatgcttaaaaagcctatgaataaaggactttttgaaggtcagctaacgcacatataatatatagaaaacatgtatgctccggctttcggatgctttttttcaactttgtgcgtttgaccaaaaacggcacaggctttttagtttgtttgaacatagcggcttgaaagcgatttcaatataatgtaggtgtaaggaggaattcaagatgagtattgaattgactagagtagatttcagactgattcacggtcaggttattaccagatggctgacacagtgccagatcaatgaaatcgtaacaatcgacactgccctgagcaaggatgctttcatgcaggaagtattcaaaatggcagctccaaagggtgtaaaaatcacaattgtaaatgtagaggatgcggtaaagcgccagcaggagggtgccttcgataagaaccgcgttatggttctgttcaagggtgtggcagaactgaatgccgcagtacaggcaggcttgaagctggaaaaggtacagatcggcggtcttggcggagggccgggtcgtaaggctgtcaacaacgcaatcacactggacagagcagatgcggatactctgcttgaactggaaaagatggggatcgaaatttatttccagacaactccggattatccttcagaaacacttcaaaaagctgtcgctaaattataacaggaggacatgtatatggtaattcaagcaatcttagtcggtatactgtactggctatccatgggacgcgcgagctattttatctcgtttgcattccgtaagccggtcgtacttggcgtatttatcggtcttgtatatggggatgtacagaccggtctgctgtatggtgcaaccattcagctgatgtatatgggaggtatcgaagccggcggaaatataccaagtgatcagggactggcaacatgtatcgcaatccctgccgctatcgcaaataatctggatccggctgctgccgtggctctggctgttccattcggggtacttggcgttttaatcaataatgtgcgtcgtaccatcaactctttctataacacgaaggctgataaattcgtagaggacaagcagtatgacaagctgtccatcttctcctttgtacttccatggcttaccaatggtgtgctatatttcacaccggtattcattgcgacattattcggctccagcgttgtacaggcattcatcaatgtaattccggaatgggcgatgaacggactcaccaacgcaggcaatatgcttccggggttaggtttcgcactgacactggttgttatgggaaaaaagaaatatctgccattcttcgtactgggattcttcctgtattctgtcatgggcttctccatgctgacaggagcagtcattgcattatgtcttgcactgatcgtatccctattcaaacagaacgatgaggaggaagttgcatgagtgaagcagtaaacagtgtagccgctgaagaaaagaaaacaatcgtaacaaaaaaagacctgttaaaggcatggtggaaatggacacttgcagtcgaggttccggtaagctttgaccgtatgcaggcacttgccttcggatattccatgaacaaggtattgcgtaagctgtacaaggatgacccggaagagctgcaggcagcaatgcgtcgtcatacatccatgttcaatacaaactgtgactggggaagtatcattcacggtattacgatttcactggaggaacagcgtgcgcttggccatgatgatatttctccggaggttattcaatccttaaagctcggtctgatgggaccacttgccggtatcggtgacagtgtggatcagggaattgttgcgacaattccattggcaatctttgttccgatggcactggagggctctgtaatcgccgcctttattcctggcttaatctatatcgcatggagctttggctggtcctggttcctattcaacaagggatattctctgggtaaaaattccgtattggaaatcctgcactccggagcaatcaaaaaggttattgacatcgcaagcatcgttggtctgttcatgatcggatgtctgtcagcctcttatataaaggtgcagaccattgtggaattcgccagtgatacatcaacggtgaagctgcaggaaatcattgacggaatcctgccgaatatgctgccgttcatcgttgttatgggaatgtatctgtatatcacgaaacgcggaccgaagtatatccgtctgatgatttatacaatgattattgcaatcgtattgaccttcttccatattatataagatgtgaacaaatccatggaagaacatggatttgttttctttacaggcatatggaggataagaaaaggaaggagcttatatgaaggtactgataaccccgagagggtttgcgaattacggtctggatcaggtggagcgaatgaagtccaagggtctggatgtacattacaatgccacgggtaaggcatatacacatgaggagtttaaagcactggcgaaggatgccgatgccattatcgtcggtgtggataaaatggacagagaaatgatggagggctgtccgaatctgaaggcggtctgcaaattcggtgtcggaacggataatatcgatctggattatgcaaaagagcatagtatctatgtcggacgctgtgtgggaagcaattcccgctccgttgcagagcatgtactgtctatgatgtttatggaagcaaagaatctgtatacgagtgtaagggatgtgaagcatcatggctggaataaaccgacaggcagagagatctatggaaagaagctgggaatcatcggctttggaatgatcggcaagtatcttgccgagtatgcttacggctgtggcatggaggtatatgcctatgatgcctttgcaatcgcagaggaaaccgcaaggcagtaccatgcacagatttccacactggaggatatccttacagactgtgattatatctctttacacgtaccgcttctggagtccacacggaatatgatttccacagaggaattcaaaaaaatgaagaaggatgcctgcctgctgaatgcagcacgcggcggtatcgtgaatgaggaagccttatatgaagcattgaagaagaaagagatacgaagtgcatgctttgatgtgtacagcagcgaacctccaagggaagatgataagctgcttacactggataatttcctgttaacgccgcacacagccgcaagaagcatggaaagtgaacagcgaacctgtgcaatgtctacggacatcatactggaacagctgatagggaactaggtgaatatatgatagaatgtgtaaaagaatatctgagcaatattgcatcggaactagggaaaaatatagaagatatggatatggaaagcattgaacgagcagcccatatcataatggaaagtgaaaagcagggaggacggatccatgtcacgggaatcggaaagccggggcatgtggcaggctatatcgcatccttgctgtcttccacaggaacgagtgcctatgagctgcatggaacagaggccgttcacggatccagcggtcaggtgaaaaaaggagatgtggtgattgccatatccaacagcggagaaacgatggagctggaggcaaccgtacagacacttatagcaaacggagcacacatcatcagctgtacgggaaatccgcaatcgacgctggcaaagcagtcggaggtatgtctggtagcgcatgtggatgaagaaggggatgcgctgaacaagccgccgcgtgcctccttcctgtcggagatcctcatcctgcaatgtctgagcgtagtcttgcaggaagcaaagaagctggatttaaaccagtatgtgaaatggcatccgggcggaagtcttggtaaaagtatcaaagagctacaaaaataaacaggaggagctatggaaaaatttaatattgtaatcggaacacatggaagattcggagaggagcttgtaaactctgcgagaatgattgcaggagcattggaaaatgtacaatgctgttctctgcttccggaatattcctttgaggactacatgaagcttgcggacgaaaccatgtgcaccaaggaaggctttaccattgtccttgtggatctgtatggcggaactccatgcaatgtatttaccgtcatgagcagaaagtatcactaccccgtgcttaccggactgaaccttccaatgctgatcgatctgtatctgaaactttccaatatggatgaagcggatctggatgaggaagcactgctgagggaaacgatggaaactctgcaaaccagctgtgttcatacgaatacacagctggaatcctgaacaaagctgtctggacaaaccctgtcatatgaattataatttccatgaaagcactatcatgcagaaggggatatattattctggtttaccgtgtggtactattggcatacagggaagatgtcagacttcatgagagttcaactcttgcgaaaggagagatcatatgctgataggtgaagtttttgaggagtttataaatgtcgttcaggaaaacaatcgctatacgattgggcttgtgaatgataatatgacagtgacattatgcagtaataaagcggaaatcggacggcagattgatgtaaaccgtccggataagcacaatgcattttttgaagtacgtgtaaagggacaggatttcggcttcctgtgggtgagtggcaatgatgaaaatctgccgatgatcagtaagcttttgaatgaatcccttaccgtacggttgatgtatgaaatcaatcagaaaaccttaaaccagaaggtcactaaggatgacgagctggtgaagtatatactgaatacggaaaactttgatatgaatcatgtgttaagccttctggatgaactggaaatagataaaaataaaccaagggtggcgatttatgtggttcataatgaaggattcaatacaaaggatgtcatgcgattgaaaatgaagccggacagtaaggaaatcatctattctctgttgaatagcaaatgcctgctgatcttcaaggatttgccggaaacttgccagtcatcgacagatttcaagccgtttatacgtgactatatccgcagtctgcgggaatgggagatgacagactgttattactttgtcggttccattcagaaaaagctgcggcagtatgcaatcagctatcagaattgtctatggctgaagaaccatgtaacatacgagaaggatgtcccggtatttttctccgattatctctatgactattttctgtcaaaggtagcggtggatgatatcagggatgtgtttgattattatagggaatgcggaaaaggtgtcgatattgaggaaatggtggacatctgcgataaactgtttgtgaatgatttcaatctgacacaagccgcagacgatctgtttctgcataaaaatacattgatatataagcttaagaaatatgaggaagtttttcagatagatgtccggggaagttttcagggaaaggttctcttaatgctgatatcctatgcattgagagaatatcagaaacgagttcaagtaggtgatgaagcatgagtacaaaaatcaaacttgcacggatagacaaacgattactgcatgcgacagttgctttgaactggaatcagtttatcgatgcagacaatgtactgattgttgatccggattatgtgaatgatccatttattgctgatgtaatgcagctttgtcttcccaagaccatgaaagttaaaattttctccatagaacaatttcttgaatatatcaatgaaggacgcaatattaaggcaatggttatttttcctaatttaagtgttgcctgtgatgcagtgaaagcgggtttccgtacgaaggaaattcaaatgccgtatccggcaagccgtatgatgatcaaaagcctctcggattatttcagtgaagaagatattgaaaagatccgttatatccagagtcagggaatccgtatgttctttcagacggcgccctttgacaataaggattactcgatctttaaaaaataaagaaaagaggacaaatatttatgtttgacggtattataacaccaatcgtaacaccgtttcatcgtgatgaggaacagagtatcaactatgaagcgacaaagcagctgatcgatcatttgatcgctaagggcgttaagggaatcttcatccttggaagcaatggagagtttcatgtgatcgaggaagcggaaaaaatagaatttgccgaaaaggtgattgggatggttgaccaccgtgtgccggtctatgtagggacaggggcatgcagcacaaaggaaaccatccgtctgtcaaagaagatggaggagctgggtgcggatgcactgagtgtcatcacaccgtattttctgacaccgacagaggaagagctggtacagcatttcacagcggttgcggaaagtgtaagtattcccatcattctctacaacatcccaaaggcaacagggtgtaacttaagcgcagaggttgtgggacgtctggtagaggtagaaaacattcgcggtatcaaggacagcagtggtaaggaagaaaatctgaaggcatacgcagagcttgcgaagcgggatgattttgatctgctgatcggttcggattccaaaatcagctatggctatgctttgggggcaagcggtgccgtggcaggaacctccaatgtgataacggaggtgctggtggagctggacagggcactgcgaaatggagaaacagaaaaagcagaggaactgcagaaggacattgatgtactgcgcggcgtattgaagctgggaacggtaccggttgtcatgaagcgtgcggcagagctggcagggattgcggaaatcggaccggcaagaaagccggtactggaatgcagtgcacaggatgatgagaaaatcaaagagatgctgcagcattaccatttattataaaaaagacctgtatccttttgggatatgcttaaataaggtttaagaaaagaggaattcaaactattggtgttcatccatagatattgaattccttttgctgtaggcatatgaaatacagaaggaatgctgatattcatcattttttttgttaagaaagggagctttgtttactatcgcagccatgcatacactatttcagctatgatatttaaaacagcttctttcattctttaggttgtttgcaaaagggagacttcagcttctattgataaatacaatacaatagtgttgaagtctctcttttttataattactcacaatcgagaaagaacctaagatatagcagctttcttcttctatcagtatgagcgaagagtaacctatttctttgttgacagttaaacactttcctcttacaatgaagcagatgaagggttgtgagattatgaaggcattggcgagtgattttgatggaacgctgtatctgcatgatgcagcagaaagctatcgtgaaggggatatagcaggaatcgggcagctgcagaagcagggctgtctgttcggtctttgtaccgggcgtcctttatggggtattacagcatttctttctaagcgactgcatcctgatttttatatcgtaagcagcggagcaatgatactggacagaaatcaaaggatattgtttgaaagctgtcttttacctgaaactgcaaagcggctcagtatgcttacgaaagatgtggaaagcaccgctattcaggctggcgggaacatctatgcatataagaaagcaagagcatttacagatattccagtcattcacgatatagaagaaataaaggggcagcaaatacacggattatcctttcgcatgacagacgaggcagccgcagaacagttatgcagttctcttgaaaagcaatttccggacacctgtgccgcattccagaatcagaatttcgttgatgtggtaccttacggctgttccaagggaaaggcgctcttgaagctgaaaaagcttatgaatctggacagctgctatggcattggagattcctacaatgatattcccatgctgcaggatgcagatgtatcctttacttttcatgcttctcctaagaaggtaaaagaagcagccgatcacctggtggattctgtaggtgaagcgattcaatcctatatgctaaggaaggaaaattaaatccgttcctggtggtaatcgtttaataaccgtaaaaaaggttcctttaaattttaaggaacctcctttcatatcttactcatgttgcttctgtgagcaggcttatgtattcttattattagctcttttctttctccatgcctgcaaaggaacataaatcatcagaagaagcagtaccgatggaatcaatatattccacggctttgcgaatttctcaatatagccctgaaagaaaatatagatcacaacaacaggcagtatgtaggaaacataaaatcttgcccacatagggaattgaaagcctacaccgctgtttgcctcatccgtgaagtttttccaaccccaaccatagcggaaggtacaaaacagcagatacatgagggatccaagcggcagcatattattggatacaatgaaatcctccagatcctgtatggtacttccatccccaagcggctctataaaggaaagaagattgaagccgaatgcacagggaagtgataaaagcagaatcaggataaagtttacacgaacagcttttttcctggaccagccgctgtccattgcgaaggcaacaatattttcaaataccgcaataatggtcgtgacagctgcaaaagacatgaacaggaagaacagaaagccccataaccttccaccagacatggcattaaatacattcggcagtgtaacaaacaccagaccgggaccgctgtctgctgcaacgttgaaggagaagcaggaaggaaatataatcagacctgctataaaggccacacaggtatccagaatgcagacattaagactctcacccagcaaagagcggtcttttccgatatagcttccaaagattgccagagcaccgattccaagactcagagtgaaaaacgcctgtcccatggctgcgaatatggcgtcccataagccgtttgccatcattttctgaaaatccggaatcagatagaattttaagccttcaacagcgtttggcagggtaactgcccgaatcacaagcacgagcatgacgataaacagacaggacatcatatatttggacatcttttccacaccgttttgaagacctctgctgcaaataaagaagccgataaccgtaattgcaatcatccagaacagattttgtcccggactggcaagcatattggagaaagcttcacccacctgctctgttcgcagaccctcaaaggtaccacttgccattttcaaacagtaattgatcatccatccaccgactgttgtataaaacatcatcagcagatagttgcctcccatacagacatactttataagatgccacttggttccttccggctccagcaaatcgaaggacttcgctgcggagcgctgggaggcacgtcccacggagaattccatcaccataatcggtaatcccagcagtatcaggaaaaccagatagagcagtacaaaggctgctcctccatattggcctgtaatatatggaaaccgccatacattgccaagaccgactgcacatccagcggatatcagaataaatcccagtctggatgatagcttttctcttgatttcatatactttctacacacctttcctgtacattttataagctgagattgggaaagtcaatgtaaaaatgaaaggattttcatatacttacacaaatccatacatgagaatttctgttttcatactagccgcaggggcctcatgcttaaagctttacacacccttcatgacagcttcacgaggtattcacataaaaggtgtaagatacaggtacagacaaagatatgtctgtttgcttaaacggcgacagttttgtttcctcatcctgataaatagctttttcataatagctgttgccctttctctttcacgaagatctctgcctttcccacagaggtctttcctttttatataagtaattatcatttttttactatattgcttcggttttttagctatcttgttggtaaggtaacaatttttcatatcaaattaacgaaaaattggtgtaattatcaattttgtgttatgatataggagagctatcatggggagttgctcaatattcaatgggagggtgggcatgactgtaacagataacgaaatttatcgtataattgttgatatcatggatatacagaatgaacctgagaatatatttgaactggataactggatccggcaaattggtcttcaggaagtatataaaaaaatcatacagatttattccatcaatcttatgtagagatttccaatgcggaatctctttttactattgcaatgcgttttatattatggtttaatatagatgcctttttatcaagagttggggtagagagttagctcgcttgatcccacgccaacctgtatgacgcatcatataaggtggtactgctaacagcgataagagaaacaatcacataacgatttgccttctctcacgctagggaaggcatttttctaataagaagcaaaggagatttgagaaatgaaaaattacatttttacatcagaaagtattactgagggacatccggataaaatttgtgaccgcattgcggacagtattctggatgaggctctgcgtcaggaccctgccagcaaaatggctgtggaggcaacgattaaggatgatttcgtacttatttacggtgaggctaataccaaggcaaagctggagtatgaggaaatcgcaaaagaggttattcgggaaatcgggtatacggaggagtatgaggtgcttgtgaaggtacgcgagcagtcttcggaaatcaaccacgcagttgtacaggatgatggcgagatcggtgcgggagatcagggaattatgttcggatatgcatgcgatgatacagacaattacatgcctgccgctattgaatatgcacataagctggcaaaacgtctgagcgatgtccgccgtggaaatgcattgctgctgccggacggcaagacacaggtaagtgttgaatatgaaaatgataaaatcaagaggattgatacgattgtcgtttccacacagcatgtggcagaggcatcacagcagcagattgccgatatcgttatgaaggatgtcataacgcctgtcattccggatgagctgctggatgaggataccatttatctgatcaacccaagcggaagctttgtcatgggaggttcctttggtgacagcggtacaacaggaagaaaaatcgttgtggacagctatggcggtatgggaagaatcggcggtggctgcttctccagtaaagatccatccaaggttgatcgcagtgcagcatattactgccgttatgtcgcaaagaatattgtggcacatcagctggcaagtaaatgtgaggtacaggttgcatatgctatcggtaaggtgaagccggtatccattatggtagatagctttggaacaggaaacaaaagtgatgaggagattcttgatatcatacgcagcaatttcagctttgaggtaaaggatatcattgaggaactcaagctttgccgtccgatttacaaggcaacatcctgctatggacatttcggcagagaagaattcagctgggagaagataaaggatttgaagtattaaaagctgacagtttccttagaagagcttcaaaggaataattgtatataaaaaaggtatcgtaagacatacggtgggtagcataccgttttgtccttgcggataccttttcttagtatatagaacttgccacaacgctttttgtatgttgtcggcgttttccataagaaacacctgaatgctaagcaagccatatgctgggtatacaaagggatggggattgtatgaagatgctattctaatgggctgttattaggtatatatttctaattttgttatattcagtttcataaaaagcttgtaagatgatgtttaaaaagctataggaatacatattgatttcttctgatctttatctgtttaatcctggcaagtgagcagtgataggaacgtaggatcgtgacctgttaggatatctcagtttgttttctaacagtgataacagcctgtttactcaaaggttcctttcttcaaaagcttttgatttttcatgaaccagcgtccgtttgccattacatcattaagctgccagtcatcatcaaacaacaagagatcagcattacttccgacagagatgcagccctttgcaggatatagtcccaatacacgggccggattcgctgttgagaaggatatgcactcggtaattgaaaaatcctgattccgcatcattttctgtacattttgcaggaggacagaaacatcggagacaccgattgcggtaaggtttccgtattcatcatagtctgaccagctcccctgtccgtcagagcttacggtgattcttccataatcctttgggttcgcctgcttgatccaggaagcacatccctcatgctcctcacaggttatatctatggtaccacccatatataaaagctgcagggctttttgaaacagctgttcatttcttgtgacatgggtcgggtgaaacatggtgcagggaagtcctgtgtttttcacggctttcatgacataggcaaggtcgtcagcttcatcacccatatgcagtgtcatacaacccggctttcctgagagcataccggctgtcctgacttcactggccagtctgagaaattcctcaaatgatatatgtgagcttctatgatcacttaatgcaagcttgacaccaaggatttcgtctataaacaggatatctttttttactgagcctgtaattgtcgtactcggataagcataggagcctgtcatggcgtaggcggagataccttcacttttaagagccttgaccttggcaatcaaatcctcaacactgcgcgtcacaccgtcagtcccaagtaaaccaaccaccgtggtgatacctgcctgtatgagagcggataactggatttccggcgtccttgtcgcaaatccgccttctccccctcctccgcttacatgaacatgacggtcaatcagtcccggtgtcagttgttttccactgccgtcagtgatttccatatagggagccgtttctatgtgaggtgctatatgggcaatgtgtccttctgaaatgagaatatcctgtatccccagatcctgtggcgcaaatatatgtacatgtttaatcagttgcatatcgtttcctcctatagggttcccaggctttttaatatatacagccacatcgtcaatgtaaatgcacttccaagcgtcgtcatcatgacaacactgctggacagcgttccctcatgacccatatttcgcgccatgatataacagcttaccgtcgtggcagaaccaagcatgacaagaattgccaccagcttatcatttacaaaacctaaagaaactgcaatcggtagaaaaatcgcaacaaatagaatcagcttcatgaagctacagatcagggcaggctttcgtttggcatagagatcgtgaaattcaaaggaacctcccatcgccatcagaccgagcggtgtcgcaagggctcccagattatgcagtgacttctgcagtatgacaggctgcgggattcggagcagggaccatagcattccggcaccaattcccagaataatcggattgcaaagtatatctctacctgtttgtaaaataagctcttttcgcaatatgccacgctttggcttcatgagcgacagcacaatgacagcgataatattatataaaggaacagtcgcaacaatcataagcggagccattcctgaatttccataaatattttgaataaaggcgatgcccagaattgcggcactgctgcgatagcttgcctgtacaaattctccctgaatacttcgatcctttaatcgataggatacagcaatcgaaaagagtatggacagcagtgttgccagaaagcagaagatgacaaaggatgtatcccacgcttttctaaggtctgtggtgctgatatcctcaaacagcaggactggcaatgctgcaacaaatacaaatttattcatttttgaaaggaaggctgcatcaaacaggtgtattcttttaaagaagtaaccaaaaatcattgttatgaataccggaatcgtggcattcagacaaaatattaaattttccattatatatccctcagctttctattatacatcgaaatttaaaaaaaggaacgcaagattttataaggagaagcatttggtttgtgatatactgaaggtaaggatcatgataaagtgaacaaatggaaatgagggctgattatgtatatgaatgaagagctgattcaggaaaagctggaggaaatgaatgcaacaaagattcagaagctggactcacagatgtatctggttaattttgatttgaaggaggatatgcggatatcctatgtcttcaatattacacgggaagggaagtattttctgcagaggatgcgcccgtattccatggtacatggcaagttctccaatgaatatgaggtgctgtccttcatcaagcatgatgttgagaagttccaaaatgcagcaaacagtaccaatttcataaagtttctggaaatttccaacaagggactgcagctgacggaggaaatcgaaaatgcctttttaaattataatgtagacggagaaattctggatgagctgaatgaaaaaatggaagaggtttttgaccagatttatctgctttccgatatttcaagaagagtgctgctgcatgaagatgagtagggttaagctgcatctgctggagctatccggctttgaaagagaacagctcgctcgcataccggacagctatattgtcacatgtgctgatagaacgagcgtgagtgctgctatggtaaaagaagcagatgtcattattggcagagtgccggtcgagcttttaggctatgcacggaaactgcggttgctgcagctggattgtgctggcagtgagcagtatacagcagatggtttgcttgcgaaggattgtcagctgtgcaatgcctccggtagctttggactggcgatcagtgaatatctgatttgtacaattttaatgctgatgcggaatatgaatctgtatatacgcaatcaggagcaggcgtactggcatatggaaggacctgtacagtcgatttacggatctacggttttgatagcaggaaccggtgatctgggacaggaatttgcgaaaagagtgaaagcaatgggggcacataccataggaattcgccggcggatacaggagagtgttccttattttgatgaactgcatactatggaagaaatgtgcaatctgcttccgcatgctgatgtggtggtactggcacttccgagtacagaaaggactcgcggatgctttggcagtaagcagcttgcctgtatgaaaaaaactgcgattcttgccaatgtaggaagaggggatgctttgaatacaaatgaattcctgcaggctatacagcgtaaacagctatctggtgctgttcttgatgtatgtgactgcgagcctcttgcaaaggagcatccgctctggaagcagccgaatgtcatcatcacacctcatatttccggcaccttccagctgaaggaatccttttatcgctttacagaaattgcactttataacctgcaggcattattggaaaacaaggcactgaagaatgtcgttgaccgaaagcagggataccgtgtgcatactgtcgattataaggaaaaataattcagcgcttaagtttcgaagaagcatttctatatttcgatacacttgctgcatgtaaaaagggagaaacaggtctatataagtttagacacagtttcatcccttttagtcgttaagaaatgcgtgagatacggctgatctgtaggcctggctacagataattaactgccagaatagcgataccgagcactgtaagcacaactccggtagcccgattcagtgttttggcgctggccttattggcaaatctagctgcaattcttgcccaaagcagggtagaggcgatgcagagaatcagagctgtcatatccggcatacctccaatggtaaagtgactgacagcaccggtaaatgcggtgaaggtcatgataaatacgctggtaccaaccgctgttttcaattcatagccaagtacgctggtcagaatcagcagcatcatcataccgccgcctgctccgatgaatccgcagataaagccgaccatcgctccggacagcatggattgcataagtctttttttcggatcggtatgctccatactgctttttgttgtcatcaccggacgtacgatgaatttaattccaagcagcagtgtcataaaggtggagaatccgcccattgctgttcccggaaccagactcgatacatagctgccaacaagtgtgaagataagtacgaatatcatcataacaagaccgttgcggatatccagatttccgtgtctgccatatgtataagcggaaacagcgctggccagcacatcacttgccagggcaattcccacagccatatagggttccatatgcaggaacgtaattagcatcggggatatgacagctgcggcactcatccctgcaaagcctgtgccaagccctgcgccaatgccggcaatgaagcagattacaaaggtatatagcataaacataactccttttttgtttataatgtatgaatattattatactcctgcaaataaggggatgcaaataattttacatcgattcaaatctatatgctaccttatgattcgtgcgacttttttgaaaaagataaaaccaccctttttatagaaggatggttttatcgtgcttttggaaacagtttcctttattttgatgtattatttagtatagcttttatacgattctttaattcctctaaggtatcacattccaaaagcagattggatacgatatgcagttgatcctcggttaatgactgtagccatgctgtacagtcttcctgaaatttggcttccatgagcctatgtaagagttgtctctctccttcaagcttaccttctgctttcccttttatgataccttccttcatcccctcctcaaagctgtcctccaagccgtagcgataacgtgcctctcccatctgaatcgccattgccgttgaccacagctcgtcatccttctgcatttcctcgtacttgttcacgaataccttcaccagcctttcctttgattccagtatatcatttttcgcattgttttcaaacaggaagcacagctgttcaaagtcatccatctgctgaatggcctttttcttagcgatttcattgataacgggcagatagatgtaggttcttctaatcaatgggtgtttactctcatcttccccctgctcattgcgcatccgatagtgattgatcagatttttattattccatgcgcatttttcaatgaaaataatctgatataccggctttaaatccttgtacttttcactgctgtccagctggttgttcaatgctctggccccataaaattcaaagcgcatcatttccgctactcctgcataggtggtctgcatttccagattaaaaaaacgacctttctcatccttcacatggacatccaaaataatgcgtttctttccgattgttccgggatccagattcgaattctgtacagtgctttcctttaccttgattccggtaacacgttcaattatggtgttgcgggcgtacacagagccttcatcctcacgtgacagtgtgtacttgaagaatacatcattacagtaatccaatacagtatttgctttcgtattttccatgacgaaaacctccttctgtaagctcatcatcacttacatatttctatacgttaagaatgtatggaattcctaaaaaatccacatattcttgattttttttaatatattctcataataagggttttttcatagataccaggagagtctgttgtatctccgttacagcagagccctgtataccgcctgtatcgttatgtgatgtaagatttcataatccgcacttaattcactcagaacttccaacagtaaattttgctgttgcatcaatgaaggaatgatatttatatagaaaaatacttggaatgcgctttcatgtgtgttatactatggttgttgagtggtatagaccactggaaaacgtgatgtttaaaggagatagggcatatggaagatacagtaaagctgaaatggtattttcgactgttttcaaaactagataatgaagcatgtaatgtggacatgacaaatcgtgcagtagcatgggggattgactggatagctggctcactgattactgcatttcctactgtcatattttatatggctttaactaaaacacaggaggtcaaccaaaatctgcttgcatttgatcagccttatggctgggtggcaggtatactcagcctgctgttctgcatcgcatattatgtgatttatccttatcgtcataacggtcagacatgtggaaagaaattcatggacatgaaaatcgttaagcgggatggaagtgatattgatttgaaatcattatgtaaacggcaaattttaggttgtataattctggaaggctgtctgattcccgggggcagctacgtttgtcagctgttatcattggcagcgggatatgatctgacgctggttcttggtgtagcaagtggtgtcatctgcttgttgtctatctatatcgcaatgaaaaagaaatccagaagaatgattcatgactacctggcagatacaaaggtagtcgcgattgagaaataatgaaagttatttataagcagacttccatgaggtctgtttttttatttgtcaaggcaaggaataaattcatatatgaagcatctttggcaaagcgtatgaagttcatggtgaagttatttaaataacaacgaaatttgaccagctagccagtatgaatgaagagatataaaaagctgcataatccgtataatatgccggcattccggattcttttaaaaagagagattaagttaccatactgttcccggaattatgcacttactatattaaaagtgtaaattgacacgctaaggttaactggctcccatgaaaaatatggaagaagcgatgcatggctatcatcagctttctttgatatactttgtgcatgagagaattgtattttctgagaagtgtagagctgtcatagattggaatagtgtttaaaatcgggcaagaagtgtgtaaaacattatgtatttgaataattctaatttctgtatggcaattcttttggaaatttaatttttttagcatctcagagaataaaataaaggtgcataagacctaggaccttatgaggaggaaacacagtatatgtatagtggaacaaagaaattaattctggactatctgatggatgaaactgcatatctaaaaagaaaaaacaggcatcattattcttccgcatatattgcagataagttcgtgatcagccggagtctgtcgagtcattacttaaacgatttgtacaaagaaggggaattgattaaggtaaatgaaagaccggtactgtatttgcataaggatatattacgtagccgcattcgcggaaaatcactgcgaagtgaatatgataccgttgaagatctggaagagctgctgcatatgggtgtttcaaaatttacaaatgtgatagggagtgattacagcttaagaagtagtatcgaaaatattaaaaaggcactgcactatccaccacacggacttccaattgtactttgcggaaagccgggttctggaaaacggtttctgagcagacagatatatgcatactgtcaggcagaacagctgatcagtgaaaatgcagaatatacctacatatcctgtgataccatcgaggagcctgagctctttacattgctgtttggaaagaatgatgaaaagagcaatgaaacagggatattaaagaattcgaagtatgagtatattgtatttaacagctttcgaaatgcaggaaaaaacattcagaatgcactggcagactatatagatgagggtgcggcactgaatgagccgaaggcaaagctgatctttctttgtaatcagcagcttgaaatgacgtttacaccgcagttgctgggacgccttttgacgattgtaacgataccatcactgaaagagcggacaatctatgaaaaggaatcactgattctgcatttcatacgggaagaatcaaagaaggttcaaaagggcttgaaggttacagattacttcatggagctgatgattgcacaggattttgaagacagcatagaacaactgcaaagtgcgattgtgcgatccttcttccatgcttatgagaaaaaggaagagcatatctgtctggatgtatcctgtattccaagtgaattgaaatacagggtgagcgtttatgataaggagcatgcctatcttctggaggaatatcagctgatataccatggaatcacaaaggagctgttttatgatatcctgcggtatgccgaggaatattattatgatacggcatcaaaatccgggaagaggctgtatgcggcggtcgaaaagtttaatgatcatattattttccgcctgccaaagttccagaagagcttggagcagtataaagcaatcatccaaagtgtcaccgatatctgtcactcacgctcaaatatttccttcagcaacaatatgcagaatctgatggtattttctttatattgccagtcgattgaatatcagatattctatgaatttatggagcggtatgaggaaagaatcaaaacactgctcacaatgctgtatgatgttgaatcaaaggaatatcaggtttacagcgaagtggaatttttgctgcataagacattttccatagaaaccaatgccttcctgaagctgcttatgattctgaatttaaagtacgatcaaacagcatttgacaatgattatgcagtaggcttaatcatctgtcatggttattcaactgcttccagtattgcgaatgccgcaaatgcattgctggcagagcaggtctatgtggcatttgatatgcctctggatgtacaggtggatgaaatcgtaaagaaaattgatacctatctgaatgaaaaacagtttttggataatgcgttgattctggtggatatgggatctctggagctgataggcaataaaatcagaaatcgttatgatatcaatatcggtatcataaacaatacgacgacctctatggctctgcatatcggatatggtatccttcagaaaagaaatattcaggaaatcctgcaggaagctagtaaacaaacggtttgtacgtataactttattcaaaaaaaggcgaagaaaaaagcaattatctttacaagcgaaagcggaatgtctactgctgagaagataaaagctctgttccaggacagtattcccaaaacgataccgatccagctgatatcatatgattattatcagattctgaatgaacagacgcaggaggaaataacgggctcctatgatgttctgtttgtcgcaggaacaatggatccaaagcttgcgggatctgatttcatcgatttgggagatattatcaatctgcgtgcaatacgccgtatcaatgatatattcagaaattatatgggagatgatgaaatacagcagtttaacgatgatctactaaagaatttttcattgatcaatgtcattgaatctttaaccattctaaatccaagggccttgctggatatcgttgaaaaatcaatacatctgcttgagcgtgagcagtcttcgaaaatcgatccgaaaattctgataggtctgtacgtgcatatctgctgctttgtagagcgcatggtaaaacgcataccggtgaaaacgtatcccgatttgcagaaattcgaggttgaacaaaaggatttcatacatcatatgagaatagcatttcaggagctttcacagcattatggaatagagattccctgcagtgagatagcatatatctatgattatatgcacattctgaatggaaatgataaagaggtttatagtgatgaataggaaaggagaatgaaatatggcaatcgttttaacaagaatcgataatcgcctactgcatggtgtggtagcgacgcaatgggcaccgtcaaccggctgtacccgcttaatggtcattgacaatgaagtggcagatgatccgcagaaaaaggaaaccatgaaattcgggcggcccagtggcgtaaatttgtccattatcaatgaggagacagctcttacaaattttaaaaaccataaatatgacacacagaaggtgtttattgtgacgaagcatccggacattctgttgaaaatcgcagctgttgagccgttgaaaaaagttaatatcggggggactgtgagaattgaaaacggtgttgagctgtcaaaccgtgcgatggcagatgaaaaggatatcatcgcatataaggaattgacgaaactaggcgcaaaagtcgagatacagtatgtgccgagtgataaggcgacaccgtttgaagctattgttaaataggaaaggagattgatctagtcctagatcaaatatacatatgaatgctatacaaataattttaattacattgctggccgctttgaaaaaggttgaccagaaggggccgcagatttttatttacaacactgtattctgggggtttttagccggtgctattatgggggatatcatgacagggatggcaattggtgccacctttcagctgatgtcgctgggagttgcggcaatcggtggaacatcagttccggattatcagattggagccatcatttctattgcgatagcagtcagtaccggacagggaattgaggcaggaatcgcagttggtcttcctgtagctatgcttgctgtacagttggatgtacttgggaatatcgcacatggtatcttcgtgcgcaaggctcagacatatgcgacggaaaggaaatggaattccttcaatatgatgtatattatctgtatcatcataaccgcattaacgactggattacctacctttcttgctgtagcatttggtgatgtgcttgtcaccacgattatagatgccatgccggtctggttcacctccggtttatcacttgccggtaaaatattaccggttgtaggatttgctgttttgctgaaatatatgccagttaaacagaatatcgaatatctgctgattgggtttgtatttgcggcatatttaaatgttcctgttttgggagtggcaattgttggagctgcattaggtttcaagctgtataaggatcagaatcgatctttggaaatggcggtatctgcaggaggtgaacagtatgatgacgaataatgaaaagaaagcgattttatcaaacaaggatttaaatcaggtaggaataagatggttcatgtccattgaaactttcaattacgaaacccagcttgccggttcctatgcttttgctgtaatgccagcacttcgtaaaatttataaggatgatagcgaattgacggaagcgatggataaccattttaaatatttcaattgtatgccttggctgacaaatttgattctgggggctactctagcattagaggataatcagggtatacaggctaaggatgctgttcaggaccttaaggtatctttgatgggaccgctttccggtattggtgacagtatcttctttattctgataccaacaattttgggttcgattacagcatatatggcacaggatggaaatcctttgggcatgattgtatggtgtatatatggtatcgtaatcggttttatcaggattaagtctgtatcctggggatataagggcggactaaagcttgtgaatgagcttggcaaaaagttgtctgtttttacgaattcaatatcagcaatgggattaactgttgtcggtgctttaataccatcccttgtgaaagtgacaacacctcttgtatttaaaatgggcgaggtaacacaagaggttcaaacaattctggacaccattatgcctgcgatgatacctgcaatattcacattcatctcctataagctgttgggaagaaatgtaaaaatatcatggcttatcctgattatcatcgtattttcctggatttgtgcagcttttggaattctggcttgatttatgcttgtatcaaccactgcaattgatataacaccgcattgtcccgtaaagctgtgcggttatatcaatgacataagacttgcccagagaacacagaccgctcatgctccaatttatgcaatagcactgcgtcttgtccttgaaaacagtcagctactgattttgacaatggatatccttagtattatgaaaaacagagctgagcaaataaaggatagtataacacaggcatattccataaaaaaagaagaaatattcatccatgcaattcatacacatgccggaccaagtggattcagtgcagatgctatggggaaagaatatgaggataatgttacatatagagaggatgtgatatccagaatatgtacaggattgaaacctgtttttgcaaaagctgaagaagctcgtgcatttatggggaaaacagaaattcatggcttttatgataatcgaaatgacaggaacagatattatgatgcagatgcatacaggcttcagtttcgaagcgatgatcagctgattgctgagcttgtgaatattaatgttcattctactgtacttggtcctactaatatggagatatcctatgatcttatcggtacgatacgtgaggaattgcataaaagagagaatatatatcctttactctgtatcggtacctcggcagatatcagcaatcgccattaccgcgagggtgatgattttaaagagcttaatcgtactgcgaaaggaatcaccaatcaattgctggaaatacaaaattttactgagattgatatgcacacacttaagctggataccttttcctataccgtttcctacgacaatacattgctgttttccggttaccagaaggaactggaagaaatacaaaaaaatctggaggcggaaacggataaaacaaaaagaaagctgcttctttcatccaaagacaaattcgaaagcaagctgcttattcataaggtacataaggaactgaagctgtcactgttgcgctttccagaactcctgctggtaacctttccgggagaactaacatccgtgtttggtaaatatataaaagaacaagcaaaaactccctttacctgtataatgacctgtaccaatgatcatcatggttattttattgagcaggatcaatatggaaggtgttatgaagcaactgctactttaattccaaagggagagacagaaaaaatgataaaaaaactgggggaactattatgagacgacttgttatcgcatcacatgaacgtatggcggaaggtgtaaaaaatacattggatttcataacaaatagcagtttctccgtatatgctgtaaatgcatatactacacagataccgttggagaaccagctacaatctgtttttgaagaatttgaaacagaggatgaaattgtaattctcacagatatgttaaccgggagtgtaaatcaggcatgtattccctatcgtaatgatcatgtattccttatgacaggtttcaacataccggcagctcttgaaatactattgtatccgcaggataaaaaactgagtgagaaagagctcctgcgtattgtggaaacagcaagagcacaactgcagttggttgtgagtacagaggaactggaagacgaataaacatggagctttctatcctaattatgaagcagctgcttgttatgttttcactgtcaggtattggattcttgctggcaaagttgaagcttattagcaatgagggctgtaaagagctcgtaaatcttctgttgtatgcggtcataccactgactgtacttaactcctttctggtcgaaaagacaccggaaaaaacacagcttcttttatattcactgttgctgagtcttgcagttttcgctgtttctatgctgttatcctacattatatatgggaaaagaaaaagagttgaaaatttctcagcagcattcagtaatgcgggcttcattggtattccactggtacaagcaactgttggaccacacgcagtattttatattgcaggctttgtagcctttctgaatatattccaatggatttatggtgcttatgttatgggagcggaacgaaggatgatttcttttcaggtaattgctaaaaatgctgttctgttatcctttataacaggctttactctatatttatgcgacttgggtaatatcctttttataaaggatatagcaaataccgtagcaaatatgaactcaccgctggcgatgatcataatcggtgtttatatgtcgcagatttcttttatgagaatgttacaaagagaaagcagttatatctgcagcctgtgtcgcctttacgtgattccattggcctctcttggcttacttgctgtgattcccttagattgttatgaggtgaaagtagcgatatgtattgtactttctgcacctgtgggtgctaatgtagctatgtttgctcagaaatttcatcaggattatacatatgcagtagaaatagtaatattatcaacactgatgtctgttgtaacacttccaatgattgtttatgccgcacagattgttttataaatatacattttgcataaaaaatccctgtctgggatttttttaggttctttcatacttagatttacccacaatcgagaaagacccttttttttatctattacttgtctatttatctcttgtcctcgttcattgcataatctgaaccttgtatgcttaccagaggttcgtatattatgaacggctgttgactttgactttacgttacttctgtatacagtaagcgcgtattgcttctggattcctttttcaattttaaaggtgatagatgcatatcaaatacgtgcaaggatatattcatcataatgaaaagcagtcttaggattgccgaaattcatataagcaataaaattttttaatattatagacggatatagaacaataattattaaaattgaaaaatttgattacaaaattattgactataacaatttatggcgttatgatatagttgtaaaaggaggctacaaacatgaaaattgtcgtatgtaaggattatgatgatgtcagtagagttatggcagaaaaggtggtcgaacaaattcgtaaaaaacctaatttggtattctgtctgcctgcggggaactctcctatcgggatgtacaaatatcttgttcagatgtacaaagagggaaaggctgatttctcacagctgagaacatttgatatggacgaatatgcagggctgactccggacgattcacacagctttatttattttatgcatcagcactttctggatcatgtcaatatcaatatggataatgtacgttatccgaaagcagatgcagcagatctggatgcggagtgtaaacagtatgcgcaggaaatcattgatgcgggcggtctggatattgcaatcaccagcattggcgatgatgggcatattgcattcaatgaaccgggagagtatttactgccacgcacacatgtcgttaaaatggatgaggcaaccagacagcagaatgcaaaagcatttgctgactgtgcaggaggtgttccggaatatgcgattacaaccggtatggaagaacatatgaaagccaaaaaatattatgtcgtttgctccggtacccacaaaggaaagctattgcataagctgttcgaaaatgaaaagctggatcctaaatttcctgtttcctggctacgtatgcacccggatgttgaatttatcatagatgaggcaactgctgcagaaattcaggaggatgcactggagtattacagagagaaataaacataacggctcatttgattctcacatcaaatgggcattttatgaagcctttggttaaataccgtttagaaaataaatcagatgatttcaaaggagaaggaaagatatgaagctgcaaattgcaactgatattgcaaataccgagacagtattcagcatagcggatgcagtccatgatgttattgacatacttgaggttggaacaccggtaatcacgaaggaaggactagtacctgtataccatgtaaaactaagatatccgaatctgtgtgtgtttgccgatacaaatatcattgatggcgaagctatggaatgtgaggatgcctgtaaagctcatgcggatatcgtaatgtaagggcaatggcagataatgcaacaatgaaagaggatgttgatacagagaaccactacaagtcgttaattttatttggatgatagacggtttacagatgctatacatagggaataaattctggcttatgtgcttgtatgatttttttaatgataatattccatttccatatgaaaaagcggtctcttgatagagaccgttttcgtgcaatattgtagttgcattatattggttatgaattggtatcctatagaaattcaggtaaaagatgatcatgtaaaatataatatttcctgggagaatcagaatcatcgctcaatagggggtatcctgttttattgtcccataagaaagttttatcctatatttctaaaagcgacattatttaaaccatctaagtatgctgacacaggatgggaaaacaaagattttcaaatattactagcatccttacaaattccgcgatttccttttatcctcatacatagcttgatctgccatgaccaacagctcctgaattcccttattccgggatgtattgctggaaaatccctttgctattgataaaggaagctcagccgtttgattatattctttcagtctttggtccagcaggctgaacattgcctgcgcggacatataatttttctcgctgagaactacaaattcatccccacctacccgatatatttgaccgatatccgtaaacacggtattcaggaggtcggcagcactgcgtataatggtatctccggcatgatgaccgtaggtatcattggtatgctttagattattgatatcaaacataaagaccgtcagaggagcatctggttttagcttttccatttcctgacagcgctgttcgtatgcagagcgattccgtgcttttgtcatggtatccgtataggcaagctggcggtaaaactgaatctgttcctgctcctgagacagcagataaaccttatgaaaggaaaagcagctcagcatgacgataaacaataataatccgatacggaagtatatattatagtcactcattggatgcagataaaaggcagtcagcgccgctgtggagaacagggcaaggataaagaaggcaagcagtatattgcgggaataatccgtcttatacaggcgaacctcacgaatcaatgcaaacagcaaggcggcaatactaaccatcatcaacagatgggtaaatggcagcatctgtacaaaatccaggatgcctgcctgataaagaatacactggacaatggtatttcccaacagtaaaagctgaagcagggtcagggaacggcaccgcagctttaatgcgtcatttataaagaccagaagcgggattggcataagcataaagctgcagaaggataataaaacgatacgcagactgccgctcacatacagctgtaatataggagaatctgtaagcagccacagtgctgtgaggaaaatgaagctcataagcgcatatagcgatgttttagacaaccagaagctgcggttcttcagccatataatcaaaaaaacaagaatgatgtcaagcagtagcagcaggattactgtgataatgattccggcattctcctgtaaaatataaaaagcaaaagaggatgcggaaaccagcattggatattctatatcagaggaaacatttgagtaattgtttttgaatttcagaagcagctctttgccactgtcttctgatgtaaccggcatacgcacatatacattacctaataatgtagaatcatcgcgatgatagccgtaatccaggcggacttcgttatcgatacaaatctgtacaccgcggtagttgtttctgatcacaagcatggtatccttcgctatctgtggcagtgtcctttttctactgaaggttttatcacgtatatctgtctttgcctcagcctgagcggctccatccttccagccgttctttaatacctcaatatcattggatttcggtggtataacagctgccggcggtgtcttttgcggaaaaataacagatactacaagacataagccaataatccacaggcatatgtaaagaagcagcattttctttcttgtcatccttccacatcctttctatcctgataattttaacatacttttcatgcacattatattttttgttaaattatcacataaaaaaactgtttcacattgacaccgattgttaactgtggtaaacttttatccgataagttatcttaaactaactaggaggtactatgattgacaaacgacttttaaaagagatgccggaaacaaagccatatatcatgaagcaggtagcgatgcagtggttctctctgctatgcaatattgtctttgtggcactgctggcaaatgtactttcacacatattttataaaaccgtcaatgaacagcttctgcttctgacaacgtgcggagtcattttgtgcattgcactaagagcagtctgtgtccgaaaagcgagcttatattcccatgaagcttcctgtcatgtgcgtgagcagcttcgcatgcggttgttcaaaaagctgctggaaatgaaaagcggctataccgaaagcgcaccgacaagcgagctggtgcagctgagcgtagaaggcattgaccagctggagatttacttcggccgatatcttccccagtttttctacagtatgcttgccccggttacactattcctgattcttgtgtggatggatgtaaaaagtgcacttgtactcttactctgtgtaccactcattccaatgtctattatcgcagtacagaaattcgcaaagaagctgctatccaaatactggagcagctatacgacgctgggagacagctttctggaaaatctgcagggtcttaccacgctgaaaatatatcaggcggatgaatggaagcagcaggagatgaatagggaagcggaaaatttccgtaaaattacgatgaaggtactgactatgcagttaaattctgtcagtgtcatggatctgattgcatatggcggtgctgctctgggcagcattgtcgcaattcttggttttcaaaacggcagtctgtcattatttcaggtgatttgtattgtattgctatcctcagagttctttataccgctgcgtctgctgggctccttctttcacattgcaatgaatggaatagcggccagtgataaaatattccgtattctggacaaaccgcagaagcaggcagaacaaaagcaatggaaagcagagacagtggatattcagctgcgtgatttgagcttttcctatgatgaacagcgcactatcctgaagcatgtctatatgcagcttaagcctggtcagtttactgctatcgttggagaaagcggttcgggcaagagtacgatcgccaggctgatagcgggcattatcaaggattaccacgggcagctgctgattgcggatacacagcgaagagacattgatgatgatgccttttatcaatcctttctgtatgtcagtcatcagccatttatcttcaagggcagtgttcgtgaaaatctggcaattgcaaaggactctctaagtgaggaagcaatgctggaggcactacgtaaggtagcattgcttgatttcgtcatggaacagggcggattggatatggaactgcaggaacagggtaataatttatcgggcggacagaaacagcgtttatccattgcaagggcattgctggcacagcgggatgtttatatctttgatgaggccgcaagcaatatcgatgcagagagtgaggacgctattgtttccgttattcataagctggcagaaacaaaaacggtaatcatgattacgcaccggttaaaaagcataaaagactgtgatcagatctatgtgattgaccagggtacctgtcaggaacacggaagacatgaggaactgctgcgtttgcggggaacctatgcaaggatgtatgaaaaacagcaggagctggaagctatggaaggagctgaacagtatgcataaaacaggaaatattcgattgatggcacgtatgagtctgcttgtaaaaccgcttgccccccatatgctgctggctgtgtttcttggtgtagccggttttctgtgtgcgatttacattccgtatttcagtgcacttctcatcagccatattgccatacaggcagcggatttcccaattggcgtgttctttgtcattatgctggtgctggcacttcttcgcggtattttacattatggggaacaggcctgcaaccactatattgcatttaagctgcttgccattctgcgggatagggtattcaccgttctgcgccgccttgctccggcgcggctggaggggcaggataagggaaatctgatttatctgatcaccagtgatattgaagcactggaggtgttttatgcacatacgatttctcctgtgctgattgcagttgtcacatccggcatactgctgatacagtttgcgaaaatgcacatcctgttctttatgatagcattgctcggatatctgttctgtggcgtcctgctgcctcttatcataacaaagctgggaacgcaggagggctgtcaatcccgggaggggtttggaagattgagcagctatgtgctggaatctctgcgcggaatgcaggatgtgctgcaatatcgtatcggaagtcaacgtatggaggaaatgcagagaaaaagtgaagagctgcacgatacagcaaagcgtctgaagctgcacgaagggacctcttcgatactcggaaatgcagttgttacgttatttacccttcttatgctgctgggcggctgtctgctgtatctgcaggggacggtaagctttacaacggtgttgatgagtaccgtgctgatggtatccagctttgggccggttctggcgcttgccagtctttccaataatctactcattaccatggcaagtgcgagacgtgtgttgcagctgctggatgaaaaagaagaggttgaagaaatcagcggaaaaaaacaggcagtcagcggggatattaaagtggagaatctgagcttttcctatgagaaggaagaggtgctgcgcaatgtgcaggcaaccttcaaaaagggaaagattaccggaattcacggaaaaagcggttccgggaaatcaacactgctgaagctgatcatgcgattctggaatgtatcacagggcagtatttctgtgcacggcgttgatttaaaggatatcaatacctcggatctgcgtaatatgcagagcctggtaacacaggaaacggttctgtttcatgatactattttcaataatattcgaattgcaaagctggatgcctctgtcgatgagattgaagaagcctgccgcaaagcgggaattcatgagtttatcatgtcactgccaaaggattatgcgacaccggttgcagagcttggtgattctctttccggaggagagcgtcaaaggattggcttggccagagcatttctacatgattgtgactgtatccttttggatgaaccaaccagtaatctggatgcgttgaacgaagcagttattctgaaaagcattcaggcacagaaggataaaacgattcttctggtatcgcacagaccaactaccatgcgcattgcggatacggtgctttctgtggaatccgggagagtcagctgatggaagccgcagccaagcgcgaaaaggaaaagcaggtcatacaggaaatgatatccctgtactgccggaaacagcatcatggtcaaagcctctgtaaggaatgtcaaacgctttgcaggtatgcacatcagcgcatagactgctgtccgtttatggaaagcaagaccttctgcagcaactgcagcgtgcattgctatcaaaaggaacagcgtgaacaaatccgcagggtcatgcgctttagcggaccaaggatgcttctgcacagaccgctcatggtcattcagcatatgtggctgtcacgaaaggagagacatacatgaaacctgtttattttatcatcggtatcgtatctatgctgctgggagccgtcggtgttgtgcttcctgttctgcctacgacaccgtttctgcttctttccgcctggtgctttgcgaaaagctcccggcgctttcactgctggtttatctcaacagcactttataaaaatcatctggattcctttgtacagcaccgctccatgacatggagaaccaagctttccctactggcagttgccagtactatgctgttatttgccatgtattttatgagtaacctgtggctgcgtctgtttttgcttgcactcatgctctttaagtattactatttcctctttcgcattaaaacgatacgggaataagatttcattaaagcattgtatgtatcagataaaaaggtatgcacgcgcataccttttgttagttggtaacgtaaagggtcaacggcccttatgctttgcctttttcttcatctgccgcagacgaaacgcttccttctgtccttctctgttcgcctttcgtctttcagctttccgctgtgcgcgttcctcctgctgctgttttactgcaagctgtgattttgtaagggaaagccctgtatcctgtgccttgcgggcttcacgctgcatgcgtttgggatttcgatggcttgcctttgagcgcacagtttccacaggagcctgaaaactgatggaataccagcagcctttcagccattcatataccacctgttcactgggttcacttccgaatacaattcgcttcaaatacagcagctgctgttcacggtattcaaacaagccaatccagaaagggtcttcaaagaagacagtaaagcttagcgaagtctgattcataatgcttcctccttatatactacataaggaaacggacaaccaaggaggcaggttactgacaattctcattgcgtctggactaccaaccagactgtgtttttattccgttattatactatcaggagtgaacgcaatcgtcaacaaattatccgtgctgtataagctgttttaaagtagtatagttcaagaatcttttcctgcaggccttctaagaaatcaccatatataggcaggttcttcatttaccaggatggcacgtaccagctcctcggcagtaaactgcttcaaccccctgtgtacctcatcctgaacaggtggatatggattaatgatgtagtaggacgtaatctgatccttatttttttcataaccgatcaccagcaccatatggtttgcatgtgcaagtgcaggatacaaagcatttaaatcaactgcggcaaaaactggatatccgtcatctatattttgtacacagcggcgtgaaaatgtatcggaagcatcctgcgtgtggtcgtctggcgacagtgtctgtacatgatagcctggctcatcagctgagggtatgctagtgccgggaaacaggtagctgtttaagactcttgccatatccacatattccgttccggttacaggatctgtatgaagctgctgtgccaggtgctgctgggtgctttctatagcgtgatagcgaagtgccatctgtatacaggccggtacacagtaatatgaagtttcctgcatactctgaacaataggaagcttattctgtttatgttcatcatccgtttcgctctgttcacgtttctcaggcatgttctccgtatcactttccataagagaaccttccttttgtctgtcagcagctgcaaaagcgccgttcctgtcaaaatgctgtgcagataggccggtggaactcgttccgtaaaccggtatctgtgtgcacgctgtgcgcataatgtatgcaaatagaaaaacaatgatactagttaacagaataaggatactgctgtaggttcgtttcatacaggtacgttctcctttcattatctatacgaggcagagatagtatatatttcatttcactgcaataaagaaatcagaacctaaaaaaatcaagaatatgtggattttttaggaatttcatacgttcttaacgtatagaagtatgtaagtgatgatgagcttacagaaggaggttttcgtcatggaaaatacgaaaacaaatactgtattggattactgcaatgatgtattcttcaagtacgccctttcccgtgaggatgaaggctctgtgtacgcccgcaacaccattattgaacgtgttaccggaatcaaggtaaaggaaagcaccgtcctcaatccgaatctggatccgggcatcatcggaaagaagcgcattattctggatgtccatgtgaaggatgagaaaggtcgtttttttaatctggaaatgcagacgacctatgcaggagtagcggaaatgatgcgctttgaattttatggggccagagcattgaacaaccagctggactgcagtgagaagtacagggatttaaagccggtatatcagattattttcattgaaaaacgcgcatggaataataaaaatctgatcaaccactatcgaatgcgcaatgagcagggagaagatgagagtaaacatccattgattagaagaacctacatccatcttcctgttatcaatgaaatcgctaagaaaaaagccatccagcagatggatgactttgaacagctgtgcttcctgtttgaaaacaatgcgaaaaatgatatactggaatcaaaggaaaggctggtgaaggtattcatgaacaagtacgaggaaatgcagaaggatgacgagctgtggtcaaccgcaatggcgattcagatgggagaggcacgttatcgctacggcttggaggacagctttgaggagggaatgaaggaaggtatcataagaggtaaagcagaaggtaaggttgaaggcaaaatcgaaggtagaatcgaaggtaagcttgaaggagagagacaactcttacataggctcatggaagccaaatttcaggaagactgtacagcatggctacagtcattaaccgaggatcaactgcatatcgtatccaatctgcttttggaatgtgataccttggagtcagttaaaaaacaattaaatagacgcaacaccatataagaatacttcataaacagcacctttatacttatgtctgtacaaagtaatggttatttatgtgtctaaccgaaagaattcataaacagcatatttataataaaggaatcaacagatgcaatacgaaaatttttacaaattcatacgtatcttgcagtctatttattttacggcttcgataaaaaagctctcagcgtaattacaatgatttgctgagggcttttcatgtctgctatatcactgcttcgaattgcggcttgattttccgtttcataatgaaaaaggaaatcaccagcagaagataggtaatatcaaaattagcatatgcggcaggtgttactatttttataaatacacatgcgacaattgcaatgatatccatacgcatatagaagctgccgaactggtagcgttttacgattcttttgcgtatcaggaaatttttcattgcaattccaccagcgacacaggcaacgatgacatctaccagataattcacaataaatttctggtccatcagatttttaaagaagaacagcacgatacagagtgagaatacataccagatactgctgatttgcattttctcataatcctgattgcgtatttttcgtttcatatccttatatacattgccacgggatagctttgtcgtatattctttcagatccctgggaattaccagcgttgctttctttctgtttttcatgccctcgagacattgttcgagggcggtattaacaatgatattgatatccgcatcggatgtattgctgtgcagtacatagtcatagaaacgcataaattctttatgataatcctcatccagctttttcatcaggtagagattgtcaatatgaatttttttctgactgctttgatttttcatggagacctatgcgacctcaatcgtttcgctgtcggtaatatgaagattggtgttatagaaggttgtcaatgcaagaatcatatactcactgtctttgatacctgcggtttcataggaggaatgcatggcaagctgagccagtccgatatccacagtatgcatggataccttctgactggagagatttccaagtgtgctgcctcctgctgcatcacttctgttagcgaaatgctgaacaggaacctctgctttttcacaaattcccgcaaagactgccgagctgactgcatcggttgtatatttctgattcgcactgaatttcacaacgattcccttattcatataggtgcagtttgtatcatctgtcttttccggatgattcgggtgtactgcatgtgcattgtcacaggataccatgaagcttttcgcaacagcacggtagtaatcctcttttgtgtaaccaaggttgtcgttgattctctgcagaacatcatacaggaaggttgagcatgcaccctgcttggttccggaaccgacctcttcattgtcaaagcaggcaaacacattgactgcttgttcatttgtcccgtgcagtaaggctttcagcgatgtgaatgcacattgcagatcgtccagcttcggtgatgagatgaattcctccttcactccccaaatgcttggggccatgcggttcaccagatacaggtctgtccctaagatgtcctcttttgcacagcccagttcatcggcaagcagctgggcataatcaccctcattgcattctccggctgagaacagcggcagcatatctatctgattgttatatttcataccgttatttacatcacggttcatatgaatggcaacattgggaatcagaagcagatcacggtcaaagcttaccagcctgcttgtaaaggtatttccttctttcacaagaacacgtcctgctaaagacagcgggcgatccatccatgttgcgcacagcataccaccatagccttccgtattcagctgcagatagccgccctttcctttcagcactgcttcttccttaaccttaaaggttggtgaatccgaatgggatgaagtaacctgaaagtggtaatcctccagactgcttccgatgtggaaggcgatcagactggagccgtttcttgtagtgaagtattttccgcccttttccagcgtccaggcttcacattcccgtaattccgtatagccgtcttccagcagcatatctttcatagtgttcactgcatgaaaacagcttggacttttctgaatgaagcttagtaattcgttcgcaatatctttatacataattgatttatcctcctgtaatctacacgtacagtatagcatggtatgcttacggggtaaacatgcctaatgatataccagatcagcggaagggggatttcctgcaaggaaatcataccctgtgcacagcattttctataaatattttttggagtctatgctaacctctcagacgatttaccacattcctcctgcatgaagggtgagcagtaaagggaaaaggtagaatgcataggatgagccaatagtaagaaagacaagaccggctgatcttgtcttaaggtttatgccttttcgtttcttttgataaccggcaggatcataccaagcgctgtcagtacgactggtgtgatgacattcagtgctgtggtgaacatgtctcccggtgtatacatacccatgatacagcatgctgcagtcagaataaagcaccagataccaaaggtcatagcgactccctgattcttaacaaaccggtattccggctgaaatttgtttcgtgccgtacgcagtgcgatataggcggcaaatacccatagataccgcataggcatagtgacagaattcagcttgttcagctgtgcaagcacgctggcagcaccaggcacgaaggactgaatcagaataatgcttccggacagaatgacaaccatccagattccgttgatataagcaccatatttgtttttcttaagcagtccggatggaataaactctctggcttcctcgttgtccagcagcatacgcagcggagcatcaatacttaataccagagttgagaactgaccgatcatgttgcacaatgcataaataatcagcagtgcatctcccatgtgatagtagccgcccagcttctggaatgcccagtaggagccgttggatacataggaattaaaggattcctgtgttccgttaattacggcaggatcaaacatcatacccattgcaatcgtacccagaatggcacatacaacaaccatgattgccagtgtaatcatacccttcgggaagcccttgcttggattttccaccttattaacataaggggagatcttttcacagccacccacggcaaacaccagaatggacagcgatgtaaaatactgcaggttaaactgcgggaagatattgtcccagctgaaatccggagtgacaaagccgccgtttggattgatgaccggtgcggcaaacatcatcagaatgtacagtatggacatgatgaacatactgcttccggcaatcgtcgccagcttcttcagcggatttaaaccgcggcttgcgacccagcagaagaacaggaagactgccagcgtacccagctgtacataaacggttggaaatgtgtcatacgtttccgcattgcgaaacactgcccagctaagtgcttttagtccaccgctgcctttacttgcgatgtatgtaatgtgacatgcccagtaggtccacccggcatagtaggcgaatttcggaccaattgtttcattgatccatgagctgactccaccaccggagtctttgaatgctgatcccagttctccgaccatgagcgcatacggcacaaagtacagagcaaacatcagaatccagctgaatataacctgaataccattgaagtatacgaagccgtttaatacatttccaaaaccccaaacggtagaaaatgccataaacgcaaggttataccagactattttctttgaactttccatttttaccctccttagaatataaatgtcgagcctagctatcataccataggtagttcataaactccatgatttttcaacattttgttcgcaaaatatactacaatttccagattttgtttatgattctccattaactttccatcattttctatccactgtatgttttgtggaaattctgtgctacaatgctgataaacagaaaggaaatgatgaacatggaaaccagacggtttgataaaaaggatgtaaaggaagttgcagagctgttgaaaaacgggcaggttgtggcatttcctacagatacggtgtttggtctgggggtcatttatgagaatgaggaagccttgcgcaaactgaaggaaagcaagggacgtccggagaataagccgattcccaccatggttgcggatgtggagcagatgaagtgtatcgcacaaatgcctgcagaagctgtggcactggcggatgcctttatgccgggagcattcactatgatcttgaaaaaacaggagacgctgccggattatgtgacgaacggatttcctaccgtgggaatccgaatgccggatgatccgtttgtactgcgtctgattaaggaatgcggaaagccgcttctggtaacgagtgccaaccgttccggagaggaaactggtgttcgggatgagcaggtgctggaacagctggacggcagaattgatgcgattgttttaggagaagcaaaaggcaagctggcgagcacgatcgtagatatgagcgaagaagaaccgcgcattgtccgtgaaggcccaatctctgcggatgatatcaaaaaggtgttacataacgcataagggatagcttctgctgaatttcatatagttatattgtcaagataaataggaaaatcagaaaaaatgaaaatcactgtccgttaatggctttgttttttcatgatttctgattttttttcagccctcttttcatgagatggatttgtgataaaatgaaatcatagaaagcaacgaggacatcctatgagaaagaaaaatatattgaaaattcatctgctgggtgaattttatatggaaaacaagaattaccggtttccgcaggaaacaaagaagagtacacagctgatccttttgatcgcctatctgatgatgtatcggcatacggtggtatccaaggaaaagctgattaaaatattgtggaaggaagatgaatcggataagccggagggtgccttgcgcaatcttgtgtatcgtgcaagaaaggaattgcagaaattttatccggataatcccgagctttcctttattctgtcaaaaggcaatacgtatgcatggaattctgaaataccatgtgagattgacatcgtgcagatggatgagctgtgcaaaaaaatcgaagaggaggaagcaccggaagcctcttatcagtattgcaaagagctgctcagcaattatatggaagacttcatgtttgaatttcatacgcaggactgggtggagctgcagaaaacctattatgacaacaatctgatgcgggcaaccaaccgcagctgcaagctgttgatggataaagaatattatgatgaagtaatcaagctgtgtgatattctgggctttaagcattatgcgaataaccatattcatgaatacaagctggaggcatatcgacagacccatcagtattcgctggcgatttcgtattaccacaaggtgaccgatatgtattacggaagactggggatcgaggtaacaccgctctgcagagaaatttatgctgaggttgtacagtgtattgccagcaatccggttgatgtggatgagctggagcagcagctgaaggagcatgtccgaaatgaaggaaccttctattgcgattttgatgtatttaaaaatatttatcagatgaatctgcgttctgcgagacgatcctcccgttcccgttatctggtgctgttgaccatgcggcagccggagggtgttaaggaagaggctcagcagagagagtcggatattctgcgcgatgttataacgacagagctgagaaaaaacgatgtgtttacgaaatgcagtccgtttcagtattccctgattattgcgacaacctcgatggaggggtgtgacagggctatcagccggatcatggatagatttgaacagaaaaaaacgatagttgaatctgaactggcatatgaatataaacatattgaatgataagtatattaagcgtataatgaagttattgtaattattatgggagtttcctatcttatgaaaggggaaagaagatggaagtgatcaaagcattcctgtttggaaatttgcaaataaattatggtgatatacacctggatgagacagatatgcgttccagccagcttgttacacttttatcttattttctgatttataacgaccgtaaaatatcatcatcggaattaaatgatatgctttgggaggatgatgaggaaatcagtaatccgcagagtgcattaaagaatctgatgtacaggctgagaaccctattaaaaaaggtgtttggtaaaacagatatgattattacaggaaaaggctcctattactggaatacatcatttaaaatcaagctggatactgataaatttgaagatttggataaaaaattaaagactgacagggagtattcgtacgaagaactgacagaaatgtttgattgtctgacgatgtatgagggtaaatttttagcaagtataagctcaaaacgatgggtcttatcactttctacatattatcattctatatatttgcgttgtgcgaagcagctggccttcagatttgaaggaaaacaggaatatgaaaaaatgaatagattatgcaaggatgctctcattcaggatcccttggatgatgaaatgcaatatctgtttatttcctcattgatgtatttaaatcattatgatttggcaaaggaacaatatcatacagccagcaagctattatatgaacgtttaggtattaagcaatcacaatttcttcaaaaggcatatatgatgctgctgaaaaataacaatgaggtaagctcgaatctggatgttattcaaaacagcatagctgaggaaaaaattgaaaaggcgttttattgtgaatttggtgtattcaaagagatttatcatctggaattgcgtagaatggtgagagaagggttttcggaatatgtggtattgatgacattgcaaccgaaaaaatttgttgatccgcattcgcaggaaggtttgcatatgttatcaaaagaaatgaatacattaaaggagattctctgtataagcttgcgaagtggagatgtgatctcaaaatacagtggatctcagtttatattcatgctgcataattgtaatgcagagaatgcaaagcaggtgattgagcgtattcagaataaatatgaatcagccaataaatacagcttcattgatttagattatacttacgatgagctgcagttgttcgaaaatgatacattgaaaggataaaatactatgaatgatcacagatactatcctaaaaatgccgtacggatatgcttgcatgagccacaacaggatgattttgatggtacattatttagctgtatcagaaaaaaggggttttcttttcacaatttcacatcttttatcattttaacggaggaaatattggattttgttggaaagccgcaatcctttcaggaaaaaagaacgtttaataaagaaaaaaaatatttgagaatcgagaatttgcatatacaagaggattgctcttatatatatgaacagcatggtgtctatgctacttatgatatcattattatgacaagacggaaaagcgattggcaggggattgtaaaaaaggatgaagaagtaataggagaatttaaaagcattcttgaattgatgcatctccttgttgtaagataaacctccctttagaggaataaaacataagtgaacaggctgtttttttcagcttgttttctttattgtagaataagtttgcttcgtgtgactgccttgttacttgtttttattatacttatatcgtaaagtagtagggtgtaatatttatgatgagaggatatgatgatatgaaaaaaataatgctggtggtcacaaccgttgtgttactcgcaatatttgtatatgagggaagcttggcattctttcacgcacagacagatatcagtgctaaaataagtgccggaaatcttgggattgaacttgtgcaggatatggataaggaaaaaataacaaagacagaaaacggttttcagattcgttcttccatgtccggggatgaaattaaggatagggtttatgtagaaaataaaagggatcattccctgtatacccgtgttgctgttacaaaatactgggtaaataaggataatgaaaaaatggtggacgcagatgcttctaaactcaaactgatcacagaagatacttccaagtggatcattattgatgatgctgataattcaaattcggaaatcgtttatttctattataagctaccattggaaaagggtggaaaaaccacgaatttagtagatgcaataaagattagccatgagataaagaatggagaatatgccgattatcgtatacatattgcttatgatgcagatgcaattcagagtatagccggagcagaggctgctttgtctgaatggggtgtagagctttctgttgatgaagaaggaagtattacttccgtagtggattagatgcaagaaggagaaagattactatgaaaaaaggtttccgaataatcacagccgttttgctggctgtactgttttccataacatcacttcaggctgctgaatctgctgctgaaacaggattaagtttcgagggagatagtgagaaatttataacctatgaacagcaaagcgcatatgagaatatgatgccgggtgaaaaaagggtacagcgcattacactgacaaacaatgatgaagaggaattaaagttttatgtgagagctgaatatacagatccgctgggggaagccgttgccgacggacatgttgcttataatgtggaatttgtaacgaataacgaaagcttttataccggacgaatcggtggtgtaacaaaggcgaatatgaattctttggaaaccaactatctgttaagatcaataaaaaaaggtgaaacagcgaccattgattttatattacaggttgatggcgattccatgaatgatacgtatcaggatacagaagggcgtttacgttttattttttcagtcgaacacatgaattcagctcctgttgaacaggctgcaaatattgtgaaaaaaatacctgtgatcaataaaataccaggagtgaatacaggtgatccaacaacgataggtttaattctcggtttttttgccgcaagtgctatcggattgatattacttattattataaaagtacgcagtcgaaggagtgaacagaatgattaagaataaaacgttatgcaagatattgtcatgctgcctgcttatggctatggtaatgttcccgttattcagtattcgtgtacatgctgcagaatatgaaattgtttttaaagctggtgctcatggaacgatcaatggaaataaagaagcatcatatcgcctatcttcagatgatgtattccctgatgaaccggatatacaggtcgaaaaggggtatgtttttgttggttggaataagcagctgcccagcgttggttctaaagtaacaggggaaatggtatatgtagctaaatacgctgttgtcattgatggggtaacgtatacgattcgttacgttgatgagaataaggtggatatcgccacacctaaaactatgctgggagagttaggaagtaatgtaacggcaagagcaaagacaattcccggttatacgtatcaaaccgcagaacaggatgctgtagtaaaagatcaattagaaatactatttgtttatactttgacgaatcctgatgaagtagtaccttatcagtcaaatacaaataatcaggctggtacaaataatcaagttggtacaaatgatacacaggggatagagaataacaatactttacataatggcgaaaataacaatatagataacaatggtgaagatgttaatgaaaatggcagccaagaggaagaaacagtcttgggagaaggcgaaacaccacaggccattgcgaaaagaaaccgtcaaatgatgatgtacgcagctggaggcggtgcagctttgcttgctattcttctattcttgttattcaaaagacgtaaaaaggaaaaagaagcttcgcagtaaagaaattttctggaaatacaagtcaaagattaagcttgaggatatatggctatccaaattttttaggggttttcgccagaaatttgggggtcaactttgggggagagaaaaaataaaggctaaaaattaagacccctaaagttaaaatcaagagaatcagtgaaaaaacattctgattctctttttttggttatgcttctgtacaaattcttaatctctttattcttttactttatatttaccacgtttctttccaacatagctatgtacttcattagatgatttgggcgtatttctcaatgcaggtctatttctggtagaccataagattcgatttctagtataattaaaattagaggaacctcgtgagtttctcttataatctttcggctttcggttgaatgattccataggtccattggataaacgtgcatagtaacgctcattatcctttgcactacgtcttgatacctcagttatagtaaatgagcgggcaatctcatgcttatatttatcaaggtattgtgagaaaagacaaggaatgtaacctctgagagccttaaattcttcaatcatttttaataattcttgcattacttcatcttcagaactaaagtgagtattattgaatctaatatatttttctttcacatctctgattatattgaacttaggatctagtgagagaaatagtttttcaatagtatatgtatctgcgtacattctaagagagctgtggtaataccttttgtcagagtaattgatattgtcttgattcttcaaaagcacccagcgatattttctaagcaagataacttcttgtgattcctgaatcgttttattgtctctattggtgtcatgattttgtttttcaagccttttaagatctctatctttatatgctttcattactgaattgatataagtattaatcaatcctaataaatatttaacaacatgaaaactatctaaaatcgacacagcatttggaaagaaatgcttgggtaattcaagataaggcttatatgcatcagaaataatataacgaacatgttttctttcttcgtatggaatggagaagaagtagttttcaatggtatgatgccatcggttatgcaagatgtcaacaatctctccagaagtaaagtccataagaatcaaggcatatttctctttttcagaaatatcaatatgtacttcatcaacggaaagaaactcaggaagagttaaacgtggcaaatccacgtaagcagtgaaaagatcgtgaacttgagtatcagataaattgaattgtctggcaatagatgcggtagaacgatcaaggtctttcatagcctctaaaactagtagaggagtaatatcagaggattgtttataacgctgaaagaatgggaaatcttcattaacatatgtggaacagttagtgcatttccactttctttggctcacgataaagatgatgcaagttccgtcttgtaagacagggtgtttgattttgcgcttataaataccttttgagtgcattctgcaagaacaattagggcaataagacgggatagatggtcgagagatatatacatacttggtatcagcgatgatttcaacatcgttgatgataatagaaccatcatcgggaatgtttaataatttaaatagataagaatgatccatgattacctccttcacagaagcataaccaatagaacattatagaaaaagaaacagatgaatgccacctgtttcttttgggatttatccccctaaagtgtccctcaaagttcagacccctaaattgacccctaaagtttagccccccaaatattttggatacccggatatatatggttgctgaaattatatatcctcaatttttattatttaaaggtcgcatatgtgtggatcaggcaatattgaattctgcgttgttaactagaatcataaattaagatgctttatatgtttgactttgtaatattccaacagtttgatgattctatccatattaaaatgtcttacctaacagacagaaggtgttactaagggcaaatgtaagaattatgaataatgtgggaaaaggattgctgaatacttatatttaaaataaaaagaaaagacgggtctttgatttattatcgcaccattcgactgcatgagattttgaacggtagtgccattgttaaagatcttccatatggagaatatgttgttacggaaatggagacactgcgatatgtatgtgttggcgatcttgtgcagcaggctgttataaatgaagagaataaaacagcggttgttaaatttcaaaataagcttgtaaaggaagagctgttttcacacactgatgtaattgaaaatagattccgtattggagatgatggtaaagtaagtataacgcaagataaattactggataatacaagtgattttaacctttacagaatatctcagaatgttttaaaggcggtagaaaaggaggaacaatagaatgaagtgttttgaaaaaataaagctaaaaatagttcttcttatagtcctcattatcgcagttgtcggcattggcacaacgtatgcatatttaacttcgagtacaaataatttagaaaatacattcacagtaggtaaaattgaaacagaaatcgaagaaaatccagaaattcaaggtagtaatataaaaaaagatccgagtgttaaaaacataggatccaatgactgcattatcaggatgagagtaactgtctcgcctaaggtaattgctgattatctatcccaaaataatggaataaattataaaacagagagttggagatataataattctgatggtttttggtattatctgggtattgtatcaccaggtaaggctactgatccgctctttactgaagtaaatggtctgcttgatgctgatggaaagattaaagaagagtttaaaaacgtatctgatttcgagattacgttatatcaggaggcagttcaggcagttgtgtgggatgctgatggaaatgagttaagtgcaatggattccaataataaattcaatcatgaaaatgcattgaaaatatggagtgcgtataaggggtctcttaattaacgtaggattttatgatgattgaggtgtgctctaaagcattataggtttcaaaaaggcagtgcaaatgtcgaacatgcactgccttttatagtgtcaaataacatcctgtgagaaagattactttttatatcatgtggcttgttaatgttatcttgtattaccatcatgtgaccggataaaggtatagtatatttgtaaaaagatagtgattaaatgaggtgtatggacatgaatagaaaaaaaattataactttatgtttatctataatattattggcactgattggggttggtggaacattagcatatttaacttctaatacggagcagttgaacaatcgttttacattttccaatggtataagcatgcagcttgatgaggaccgcattgataaaaatttgcatacggttactgaagaaaacggtgtgattgcaggatcagataaaggtaatgattacttaaatgttcttccaggggaagttttgcataaagatcctaccgttaccattttagctaattcacctgattgctatgtttttgtaagtgttaaaaatccctctgaagaattgctttctttgaatatatctgatgaatggatgtttattgataaaatagatgatatctcctactatgtctatgtaaaggatggacaacctgaatcagtaaaggcatcaaagcaaaatacaagacttacaccggtttttgattctgtaacggtcgctaatataataaataaagataattctgagctggttagtttgagtgatatagaagtaaaagcatccgcagtacagtcaaaggtggcaggtgaagataactatgatgaagtaaaagcagaaggattgggtttgctgggatatcatgttgaataatagaagaatgaattttactcatttatatatgtttgttacctgtatgtgactttaatgtgatattctaataacaggagatgatgaaatggatgaaaaaaacaattgcgaaaaagcaactttcattgttgatataaaaaacagagagaatcacagctggcagggtacgttgacgtgggtggataccaataaagaaatatgctttcgaagtgcgttggaattgattaaaataatcgattctactatgcctggggatgaaaatgattaatatacttaatcgaacggcatatgttttgctgggaatccttttgttaatgatagctccctttctgattcctaaagtgattgggtttataccttatgctgtactaacagatagtatggaaccggcatattcagtcggcagcttgatttatgtaaaagaaagtgcaccggagacgattcaggtaggcgatgtcattacgtttcgtcttgatgtaaaaagcggtcagcttgccacacatagagttgtagctaataatacgaaggataaggaattaaggggatcacaatgattatcaggatgcggcaggtgttgcttatgagcgtctcatcggaagggtggcaggcagtgtaccggtcttaggttatttatacagcttccttgtttcctcaacaggaattgcactagaaacatttattgtggcgatgattataatcctttggctacttgtgtatacatcaacaaggaaaaatcattgcaagcaaaagaaatgaatataatctttgcaattgtatcaaaggtttataggtatgcaagaaatagaaagcaaaagagtttgatgcggtatgtctttattggattgtaagaatgctagaaaaatattgtaattataataaagtgctattttatgcaatagaaaaagaggcggtcatttttctgcctctttaattctgtgtctgtaggtcaccttgtgaatacagaaaaatatcgatttcttatctcagtagtagaagcggcagtaagcagattagcttatcaggaatcaaatctaatactgatagtgctgggtaattatttgctgaattatggattccttggtttaatatgcatgcatataacatatatagtaaattgaaacattttaagttttaaagagacacagaataacctattcaatttaggtaattgtttctgtaatgatatcaatcgatcctgcgtcttgttttatagttttttgttttctcaggctgcttacattctgtctgctgtatgttataatgagaaaggatattataagaggaggaactgtatatgaaaatagcggtagcttgtgatcacggtgcttttgagtataaggaaatcgtgaaggaaatgttaacggaaatgggacatgaggtcgaagacttcggatgtcatggatgtgagtctgtggattatccggactacgcaggaccggctgcacagagtgttgcggatggtaaaaacgataagggaatcgttatctgcggaacaggaatcggtgtcagcattgccgccaacaagattaagggaatccgttgtgcgctttgcagtgatccggttagtgccaaactgacaagagagcacaataactccaatgtgctggcgatgggacaaagaattatcggtgtggagctgatgaaggaaattgtacgtgtttgggtaaataccgagttttcccatgatgagcgccaccagagaagaattgacaaggtaatggctctggaaaaataatatgaggaaaactgcaggaatgctgctgtccctggccgttctgtatgtatacggataccgtttgaagcagcgtcaggctgcctgtcccttttataaggtttggcatggagatgaagaaatcatacaaatatgtctttccggtgtcgtttccattcagaaagggcagagaaaggtattcggttatatcagcagctgtgatgagatggaacaggatatctggaaatttcatgtcagactgcgcaggcacggcggtattctctgctttcgatatgcagagcagagtcttcagcagctttctgcggatggcagtgtcctgcatacatacaggtgaggatgaagtctatggcaaattggaacccctggcatggctgtcataagatcagtgccggatgtgagcattgctatgtataccggatggacgaaagacatggcaaagaaaccggtgttgttacccgtctgaaggactttgataaagttttgcacaaaaatcgcaaaggtgaatacaagatagcatccgatgaaatcgtctatacctgttttaccagcgatttttttgtagaggaagcagatgtatggagagatgaagcatggaatatcatgcgacagcgcagggatttatttttctttatgattacaaagcggatcgacaggctgatgaaatgcattccgtatgactggggaacgggatgggatcatgtgggaatcgcctgtacggtggaaacgatggagcgcgcagcgtatcgtcttcccatttatcaggcagcacctctgcgtcataagtatgtggtatgtgaaccgctgctggagcccttaaacctgaggccctggctggatgatagcattgaagagctgatcgttggaggagaaagcggaccacaggcaagggtctgccggtatgagtggattctcgatttgcgcaagcagtgtgaggaaaagggcatatccttctggtttaaacagaccggtgcaaattttgtgaaggacaatattcattaccgcataccgcgcagacagcagcatttgcaggctaaaaaagcggatatcaacctgaatccggaaattatcttataatgctaaggaggaagacatgcacaaaatcaacacaagacttgttaaaatgatgaaggccgttgagcttgtgattgccgtgttgttaatgatcgccatcgcaatatcaacgctggcaacggtatgctttggggcggagtctcttatgaatcagagctttcagctggatgctatactggaaaaggcactgactctggttgtcggggtggaatttgtaaagatgctgattctgcatacaccggaatcagtaatcgaggtactgctgtatgcggttgcccgtcagatcattatatcgcatgaaagtgccatggaaaatctggtaggagtgctggcagtggcactgatttttgttgtaaagaaatatttcctgatgaacgcagaacaaaagaaatgacaatataaaaatctgtggtaaaatagaggcattaaacggaggtagcgtatgaacgataagaaaattcaggaagccattgaaagagaagcagagcgccagctgtataatatcgaattgatcgcatcagaaaattatgtatcaagggatgtactggaggctgccggaagcatactgacaaataaatatgcagaaggctatccgagcaagcgttattacggaggctgtgtacatgttgatgagatagaagaaatcgcaagagagcgggcaaagcagctgtttaacgctgagcatgccaatgtgcagccgcacagcggttctcaggcaaacatgggcgtatatttatctgttttacagccaggtgataccgtactggggatgaatctgacggcaggaggtcatctgacacacggacatcctttaaacttttccggaacgttgtacaggtttgtggattacggtgtaacaaaggacagtgaaacgatcgattatgaggaggtgcgcagagtcgcattaaaggaacagccgaagctgattgttgccggtgccagtgcctatccaagagtaattgattttgcgaaattccgtgaaattgcggatgaagtcggtgcatatttcatggtggatatggctcatattgcaggacttgtagcggcaggtgaacacccgagcccggtaccttatgcagattttgtgacaacgacgacacacaaaacactgcgcggacctcgcggaggattgatcctctgtaaaaaagagcatgcggcattgctggataaaaaggtgtttccgggtatgcagggcggcccactgatgcatatcattgcggctaaggcggtatgtctgcaggaagctatgcagccggagttcaaggagtacgcaaaacagataattgcaaactgtgcagtcatgagcaatacattgaaggaagaaggctttcgcattgtaagcggcggaacggataaccatctgattcttgttgatgtgaaatcctctctgaacatgagtggaaagcttgcggagaagctgctggatgaagcaggaattacctgcaataagaacacgattccatttgaaacagaaaagccgtttgtgacaagcggtatccgactggggactgcggcaatgacaaccagaggcttcaaggaaaatgaattccgtcaggttgccttatggatcagccgtgtgctgaaaaatgcagaggatgaagcagtgcgtgaagaagtgcgcaaggaagtgcgtgcgcttaccgttcagtttccgctgccgaatgagaaataagaaaacatgcaatgggagcggacttgagtctgctcccatttcaacagtttgcaagcactagaataagtattgtaaatctgcaaatagtgcataatcgtgtaggttatgtacacaaagaagagtctatccggatcctgtatgtcataaggcggtatgttgagaaaaggaaggaaaaaagagttttcaattgcacagaaaaagctcaactaaaagggaaaagcttattgctttaaaatcctaaaaatggcaaaatgataagaactcctcaataattctgctcagttgccaatcaacaggatgtattttatatttcaaaaggaatctggtgttaaaaagctttctttaccaagtcgattcctgtgaaaatgaaatgaaaaaaagacatgggagttttatgattattagatattggctttagtgcagcttactgtaggtctttttcagttcaagcagaacatccacatgctggaaatcctttggatataccagattgatttcccgtatcatggtagaatttgtaatcggaatggttttcagccgtcccttttgctcatcctccctacaggcattatgggacatgatggatacccccatattgctcatgaccagctctttgatagtcgcaagtgaatctgtttcaattaagatgcggtagttgcggatagagtcacgctgggattccagatagctttcaaaaatttctctggtaccggcttccttcgaccgcaatataaagctttcctccaatagctcattcatcgacacgctgctgcgattggcaaggggatgctgcggagaaacaatcaaacagagataatcggtatccaaaagaatggaatgatatttatcggaggttagtcttccatcaataatagcaaaatctgcttcatataatttcagtttattataaatattatttatggaatcagtaatcagatttatatgcacatcgctatgctcacgacagtatgccgcaagaagctggggaatatagtactctcctgcagttggtgttgtggcgatattaaagcggtgcagatggtttctggcatcctctaaagcctgatgtgtattgttgtagacagccgtcatgcggtgggcatacttgactaaaatttcaccctccggcgttaaaataaggctttttttgctcctgtgaaagattttaatctgaaattcatcttccagctgcttgatctggtgactgattgccggctgtgttaaatgcagctgccttgctgcttttgtgtagcatcagcaatctatcagagtaagcagggaaacgatttttgtatccagcatgttgcgacctccttattataaaatttattgatatttgactaaattattataattagattttatcaccgttctctcatataatcaatggtgtgaggaggcggttgttatgatagctgatttcttaaagcagcagggtaatgcaggaatcatcctttccatcgccataattttactggcgggatttctctgtacgagagtcacaaaaaggctgcgttttcctaatgtgagcggatatattatttccggtattctgattggaccctgtgttctgcagatgattcccgaggaagtggttgcagggatggatttcatgacggatatcgcactggcgtttatcgcctttggtgtgggtaaatacttcaaaagggatattctcaaaaagcagggaagtaaaattctaacaatcacgatattcgaagctttgacagcaggagcctgcattaccatagcaatggtaacactgttccgtcttccatggtcattttcactactgctgggtgccatcggctgtgcaactgctcccgcttccacgattatgacgattcgccagtatcatgcgaagggaaatttcgtggataccatccttcaggtaactgcgcttgatgatgccgtcgctttgatagcgttcagtatatgtacagcacttgtggaattcatgcatgcggatcaggcactgcaatggtcactcattctgcttcctgtcgtgtggaatctgcttgctgtcattctggcggtcgtactggcatggatactacaccgtatcatcagtgaaaaacgctccagtgatcaccgccttgtattggtgattgctgtaattctaacattgacagggctttgcagctgctttgatatatcaccgctattatcctgtatggtgctcggcgcagtatatatcaatttatcagggaacaaagatctgttccgtcaggttaacagctttacaccgccgattacgctgctgttctttgttttatccgggatgcggctgaatttatatgcgccgatttcctgtggcctaattggtgttgtctatttctttgtccgcattatcgggaaagcctgtggagcgtgggcaggcgcatggctgtctcatgccagcacttccgtcagacactatctgggacttgcactgattccacaggccggtgtttccatagggctggctatactcgggcagcgcctgcttccaactgctgagggtaccatgctgtcgctgatcatattatccagtgctgtattatatgagatgatcggtcctgcatgcgcaaagctttctctgaaattatccggtagtatagagagtgatgatccatctgtgaatgctaagctagtagaccgggcaaaaacaatataaaataccggtagggaaaaacaggtataaaagaggccagtttcagtaactcagacatgaaatggacctcttttgcttttttttggattatgattttagtttgtcttcaggtacattacgagaatgttatctatttattctttcaggcatgctcacagacctcttccataaaatatgccgaggatttcctctatcgatgctgctttctgtattttttctatgaagctttcagagctgatcaaatggtagaggtcttttaacagccttcgcatggtatccttctgctcaaacgatacagcggtaaataaaatgacacttaccatgtcatcccgccacaggattgcatcctccagtgtaatcaaaacaatagaggtttgctttacatatttatcagagccgtgaggaatcgcgataccgtttccaatttccgttgatgaaatcttctctctgtttttcacactttcaaaaaattcttcttctacataaccctttttcaggaggatttcatttgcctttttcaggatgtcctcctttgtcttacatttttcatgaaccagaatcgtatcagcactgattgcctgaataagataaggaaagcgcgattcctttacatttcttataagcttttcatacgtttgtttaatacgctgaatatcgccaaagtccgctaccggtgaaataacaacagaaggaatatctttcatatccaattccatcgtggcgatgatgaaatcaaaatgccgaagatactctttttttaaatcatgaatattgatcagctctataacatcaaaggtgggcagattgattttaatctgattttcaatcagcatagcgctcgcaaggccgcagttgtatacgactgctattttttttgacaggttgtgccgctccagtgctgcctgaaagtgaatcagaataaatccgatttcatcatcagacaaggtgaatcccagctttttctccagtatgctggaagccagtgaaactacactgaacatggcggtatattgctgcttgatctgcataataaagggatgtgtgatttttatattgttctttagacgggcaatcatcggaataaagtgtttcgataagccgttttttaacaactcatcactgataaagtctgcgttgaagatatcaccaatggaagaaatcaattccgtcactgtatctaatatgatgggagagtaatccgctgtttcttttcggtcttcatgatatactccggacaagcgtgcattaacccatctaatatctaaatcattgactctgatgtggtgcacttcctttagccactgtatgatttcctctgtaatcggataggtcttcagcacatgcagctccgtgacaaccggtctggcaggtgcttctgtaatttcatgtccttttttgatccgctggataaatatggagtaggatataaatatctgtgcataataattggtatccatgcgaaatcccagcttgtcctgtgcaatttcaatcatgcttcgagcgattatctgcagctcgtctgctacatagcgtgataaaattttcgtacacagggtgaggtccataatttgatcctgctgtgtcagggacataatctcttcaaaaataaacttacgctttgcactgcgaatacgctgctcctttgcctcaatacgcgtcccggcctttgtgcgaagcagtaagatgtcctgctgtagcagctcctgctccaccttttccaaatccttcacaatggatgtggagcttatacagaattcatcggataacctgcgtacagaaatgctttcatccagcattaacagcttttccattatttttttgcgtctgcattcacttgtaaggctgtctcctgcagttctctggatagacttttgaagcagctttacagcgctttgatctccttccatacggataccaaccccatgctttgccgtgatatccaattcgtattccttcatgtgataacgcagctctgtaatataatttgaaattgttttatttgaaaccatgagcttttctgcgaaataactggtcttacgataatcactttcttccagtaacagatttaaaaacttagatagtgcagatgttttcatttgatttctcctcctgctttatcatgatagaatttcccattaacataatagaatgattttgaggaaaaagaaatagcaacttgcttctgtttatagtagaaaataaaatacacgtcgatatagagtgccatagataggtgctttaaattgaatgcaggaaataacacagcaaacatagctgtgtgtttttatttccacaacttgtggaagacggttggtatttcaaaaaaaattgcagaactatacaatgagggcgtagaaaggagtggtcaaatgtttgaaccggaaattgtgaaggtgtccagcacaaggtttgaaacaaaggaagaaatcattacgtatctgagtcaaaaggcgggacatgctaaaaaaatcaagaatgttaaaagctatgtcgatgcagtactggatcgtgagtccacggcatcaactgctgtgggatttggaattgcgattccacatggtgaatccgatgcggttacggaaacctttgtagcctgtctgcatctgctgcaccctgttcaatgggatcacgatgaggttgatctcgtatttatgataggtgtcccgctttccagtagaaacaaagagcacctgcgtatactggcaatgctgagccgacacctgatgaaggaggcgttccgtaaggagctgcgcaaaataagaactgatcaggaattttatgagtgcattaaattcctggagcatgaaaattgaggaggaaaacaaaatgaaaattgtagcggttgccgcatgtaccatcggtattgcacacacatacatggcgcaggaagccatcgaacaggagtgcaaaaagcgcggttatgaatgcaaggtggaaacacagggcggtatgggaattgaaaatgaactggatgaggatgaaatagcagctgcagatgccgttattctggcgattgccatcggtatcgagggggaagaacggttcgaggaaaaggaagaagaggggaaaatcattaagattgacccgtccgtagtcatacgggatccggctgaaatcattgatcaggcagagaaattataaaattaaataaagtgaggagagcttatgtttaaaaatttaggaaaagatttagttaaggcatttaacacaggggtatcatactttcttccggcagttgtaatcggcggtgtatttctggcattcgcattggcaaccggagaagcgggcagtgacggcatgaaggtgacaaacggctttatgcagaatatcaatacaatcggttccgcaggtatggcgatgatgataccgatgcttgccggttacatcgcatattcactcgcaggaaagcctgcgcttgccccgggtatgattgtgggctatatagcaaataatccggtgggagaatacaatgtatccacaggctttctgggagccatgattatggggattctggtgggatatgtatgtaagtggatcaaaagctggaaggtgggaccgacaataaaatccatcatgcccgtcctgattattccgattgtttccgctttgatttgctgccttgcatatctttacattctggtgggtcctctgggtgcattgatgaaggcattaaccggtatgctgagtggcatgcagggaggaagtgcgattcttctgggaatcgtgattggtgtgatgaccgcctttgatatgggtgggccgataaataaaactgcatctgcctttacgatggctttgatggcggaaggactgtatggacctaacggcgcattccgcgtcgctgtggcgatccctcctctgggtctggcattatccactttcatttcccgaagaaaatacgataatgcggagaagcagctgggggtgaccagtgcgtttatgggactgattggtattacagagggggcaataccgtttgcagtaaaggatatcaagcatgttttacctgccattatgggtggaagtgcagttggagccggtcttgcgatgatgcatgcaattgaatgctacgttccccatggcgggatgattgttgttgcggctacgaataagccattattatatacactggatatggcaatcggcgttgttgtcacagcattgcttctaatgctgctgaaaccgaatctcgagaataaggataaaaaaacagagaagctgtctgtaactgaagataataaagcatctgtgaaataggctgtatgaagcaaattgtagtattgggaacagatttggacacggcaatggcttacggagtgcagcacggcgcttcacaaatgtatttcacgttcataggggatgagaatgcagaagaaaatattatgaggaatgaagatagaagcaaacagctggagaaagcaggattacgctttaaatgtataagaagcaaacaagagccgcaggattgctatgctcttgttcatgcggatgaggtgctgcttggtatattcaaagaacagcaggattcatatagggactatttaaaagcagtactgccaatgcgggccaaaacaaatgccggacagccgttatctatacggtataagaaaaaatacaaagcgaaagtgctgtactttatgaatgagctttatcaggctatgcaggaagaggaagctgaatggtttcatcagatggtgaacatgcaggagctggtatagtcaaatgaatgaaatggaagtcgaaaggaaatggagatagaaattatgaacaaattaccaatcaagaaggtagtggaaggcttattgaaattacaggatacaggagaaagtgcaacgcttctgggcattgggccgatgtcaccgaatctgttgcaggcaagctttgaaattgcgagggattatgattttcctttaatgttcattgccagccggaatcaggtggatgcagatgaattaggcggcggctatgtaaacggctggaatcagaaacgctttcaggacgatatacgcgcagttgctgagcaggttggctttgatggcttgtattatctgtgcagggatcatggaggaccatggcaaagagataatgagcggaatgcacacctgagcgaggaggaggccatgaggctggcacgacagtcttatcttgcggatattgaaaacggctttgatttattgatgatcgatccgacaaaggatccctttgaaattggaaaggtgatacctctggatgttgttttacagaggacagtggagctgattgcttattgtgaggaagaacgcaagcgtagaaatttaccggaaatagggtatgaggtcggtacggaggaaacaaatggcggtttgacatcgacagaaaaatatcgcgagtttattgaaaagctggaaaaagagttgaaggttaagggactgccgatgcctacctttatcgtcgggcagacaggaacactgaccagaaaaacagagcaggtaggaacgtataatttccataatgcatatgatctggctgccatggcaaaagcatacggtgtcggattaaaggagcataatgcagattatctggatgatgtaactctgctggagcatattcctgcaaatgtaacggcaagtaatgtcgcaccgcagtatggaacagaagagacaagagcatatctcaagctgtgcgaggttgaggatattctgaaaaaggaaggactgcttgaaaaaacttcttcgttaagaaagacgttgctggttaaggcgataaaaacagagcgttggagaaaatggatgatcggggaacagcgcaatctgcaggttgccgatattttgaaggatgaacagctgtcactggatgttctggatatcgcaggacactatgcattcaatgatgcggacgtaaagaaagagctgcggatactgtatgagaatctggcgaagcatcatattgatggacagcggtttgttgttgatcatatcaagagaccgctgcagcagtatgcggaatgctatcatctgaagggagttaccagcagagttcgcagaataatcgaataatatgatgaaacaggagtcgaaagggttgtttgacttctgtttttgcttgcttgtgcaatgctgcagggaatataggagtacatatacctcctgcatatataaagcttgacgtatgtgtgtaatctggatacaatcaccatagcgggtacattgtcaaacacagaaaagaatacagggaggaaacagaatgagtgaaggattaaaacatatatgctttgatttagatgatacgctgtatgaacagattgcaccttttcgacaggcgttgcttactattcaatcggtatcaaatgagcagataagaagaatttataaaagctttcgcatccgtagcaatgaattgttttttcggcatcagaataaagagatatcttttgaagccatgcagattggacgcattcagcttgcattaaaagaccatgacattttgattatggatgaggaagcgttaaaatttcaagctgcttatcagaggggtcaatatgagatttcattaagtgatacgctagtggaaatactggattatttgaaaagcagggatgtaagaatcagtttgataaccaatggaccgtatgagcatcagctgaagaaaataaggagtcttggtctggggaagtggatagaggaaaaggatatgatcatttcatccgcggtaggcatctcgaaaccggatgaacgtattttccatatggtatgtgaaagcgggctgtatgtcggagattcttatgaaaatgatgtaatcggtgcgaagaaggcaggctgggatgttatctggctgaataaatacggacaacaggaagctgatcaaaaagctgattttaccgcgcgggatgaaagagaactgcaatcactcttacacaatttctttgattttgatggaagctgtatgtgttaacgaatgtggtcagttgtcatgaaatacatttattttcatggcagttgctatctgtttgggatataataaacctatagaataggagatgattgtatgaagcaaatacctattggaatagagaattttaaagagctgatagataaagattattattatgttgataaaactttatttattagtgatgtattaaaagaaaaggttgctctttgtaccaggccacgccgattcggtaaaaccttgaacatgagtaggcgctgcccgcccaggcgtgttatattatttcttttccattcgccaagcggataatgcatatctatttgatggattagaaatttcaaaaaataaggaagcaatgcagtatcagaatcaatatcctgttatttttatgtcattgaaggatctaaaagatttatcatttcaagatcagttaaataattttcaaattatcttaagtgaaattataagcaggaatgaagaattgcttatcagtgagcatttggatgaaatggatagagatttattaaagagatataaagcaggtacagtaaataaagcacagcttcagaatggactacgatttctaagtaattgtttagagaagcattggaaaaaaaaggttgttcttttgattgatgagtaggcgctgcccgcccgtggcgtgatgttcctctacaaagcgcctacctgaatggttattatgatgatatggttgtttttctaaaaaatatgttcagtgcagcattaaaaactaatgatgcggtggagaaaggtatattgacaggttgtttaagaatagcgagagaatctacaccactggcgggctttagccttttcacaggattgaataattttaaggtcattactattttcgatgatacatccaatcagcaatttggattcacacaaaaagaaatggactcactattatcagattatcaggcagaggcatatcgggataaagtgaaggaatggtaggcgctgcccgcccatggcgtgacggataccagtttggtagctgtgatatctacactactagtgggcagagcctaatccatggagtgttttaatgtatatagaaaagctgaataagacgcatctgcatgagccggaatcgttctgggcgaacaccagtggtaatgatattatttaccggtatataaaagaagcaaatcccaaaatgcgggaagagtttgatatactggtatccggtggagtgatagaaaaaccaatcaaggatacgataacctatagggaaatggatcagataaacaacgtttacagttttctgttatttaccggttatctaaaggcaattaaatgtgttgataatgaaaaaaggatgtatcggttatcaatacccaataaggaaatcaagcaaatctatgtgtctatattcagtgaatggttcaatgaacaggtagaacataatggtacatcttttgtagaggcgttacggaaagaacagataaggaatgcaactgaaatattaaataacgtattatttcaaagcatcagctatttcgattatgatgagaaattctatcatggacttctgcttggaatgttgaatgactatatagtggcttcaaataaggagtacggtttaggcagagcggatattgcaattctgccgcgttctatcatggatagaggactgatattggagttaaaaattgcgacatcaatggcagaagtaagatcaatggcgcaaaaagcctgtgagcaaatccggcagaagaaatatatggaggggctgttagcgaatggatatgaggatgtgattggatacggtattgcattttataaaaaatcgtgtgtcattacaaaggtatagtgagatgaagctgtaatcgtggataaatgaaaagggaaattcttcaatatggggattctctttttttatgtattgctgataagcttgagaaaatttggattaagatgcttgcttttcctttaacatgaactgctcgttgcaagatagatgaacgtttaaagatagcagggtaccgtgcatacatattgtactacttatagcatattatttctatctatagtaaattggcattgaagttaagcgaatgatgatttagataacacaatatttataacatatgtaatgtatataccgtaatttctaaaattatttgttgtgggataaattcctatactaaaattcacaaagaaaaaagtgcgcagcgcttttacgtattgcttctggatattagtcactgaaaaacataaagaataatcatttccagtgcatacataatatataggaaagcacttgaaaaaggtggtgaaaaaatgcacaaaagggggaaaaagcagggtgttcatggtataataaaaacaacgtggccagaatttatacaattcgtttgaattgtctgtctactgttggaacggattatggtacgctatatccgtattgattatgtaaggagattattatgctgaaagtcttacaacatccattgattacgcataagctgacacagatgcgtaaaaaggaaaccggaacaaaggatttccgccagaatctggatgagatcgcaggtctgatggcttacgaaatttccagagatttcccgcttcagccagtcgaaatcaacacacctgtcgcaaagaccacaacctatgagcttgcgaaggaaatcgtactggtaccgattctacgtgcaggtcttggtatggtgaatggaatctgtgatttgatccctaccgtcaagattgcacatgtggggctgtatcgtgatgaagaaacactggagcctcatacatattttgaaaagtatccgaaggaagtaaaggacgctatcgttatgatcgttgatccgatgctggcaaccggaggaagtgcaatcgccgccattgacatggtaaagaaacagggcgctaagaatatccgccttgtctgtctggtcggagctccggagggtgtaagggccgtggaagaagcacatccggaagtggatatctatcttgcggcactggatgaaaaactgaatgaaaaagggtatatcgtacccggacttggagatgcaggagaccgtattttcggtacgaagtagtcatgaaggaagcgtatcaggctatgcggcagatgtttaccatggcacttgcctgtggggcagcggtatggatcggtgcctggctggatgatgtatttcatacctcgccatggtgtcttctgattctgttagcctacgccatcatctccagtttgtatctgatgattcgaaagctgggtgatgatcatgaatgaaacaaggaaaatgggaatggagatccgcatacttacgctgctgctctgtgcggcaggctgtgtggtctgcatcatcctgtttcccggagcgtggaagtcaggtgtcatgggtattctgatcggctccttaaccggtattatgggcttcaacatgatccagaacatggttgggcacattgacggagaactggcggatatcaaatcccgtgcatttcgctcctatacgcgaagatatatgctgtatgccgttatctttgccttaagtgccatcgcaggtgcgcatatcgcggctctgctggtgggaatgctgcttcataagtgcagtattctgatttacagctggaaacacagaaaggaggatgagtagtggacgataagtttgacggaatcgttttgacactgtttggatacaacatcgaatttcagcagtcgattatcaactggctgattctctgtgtgctgttttccatattctttatctgggccggcaaaaagtttgaaaaggccgatgttcgaaaggcgccgtcgggaatacttctgattacagaaatgattaccgggctgtgtaccaatattatcggggataacctgaagcatgaaacgaagcattatctgtcgtttctgggtacactgaccatgatgatggccgtcagcaatcttttgggacttctcggactgcagccgccgacatccaatttgagcttcaatgttacccttgcactgatgatgtttctgaccattcagtataacggtatcaaaaaaggcgggcttggcgcacgtctgaaggagctgacggagccgatgtggctgcttacaccattgaatgtcattggtgagctggcacttccgatttcgctttccatgcgtttgtttggaaacatactggcaggctccattattatgctgctggtgtatacaatgatgcgaagctttctcccgtttggagtgctcggatacattgcgacaccgtttctgcatgcgtattttgatgtgttctcaggtctgatacagacctatatcttcttcacgctggcaagcttcttccttagtgaacaggttgccccggaagaataacaaatgatgttaacaggaggaaaaaattatggaattcaatgaatattttgtacagggtatggcactgttaggtgcaggtattgcaatgatcgccgggttaggtcctggtatcggacagggtatcgctgccagcaagggtgcggaaagtgttggacgcaatccggatgctgcaggtaagattcgttccatcatggtacttggtatcgctttggcggaaacaacgggtatctatgcattgattgttgccttgattctaatcttcatgaaagggtaatgtcattcatcatgaagctatgaagaaaggaggtattcgcatagtatggattttgatataaatgcctatctgcggctgaatccgatggatatgatcatggtctgtgtatcaacgctgatcatcatcgctatcgcaaagcattttttctgggacaaggtgcttgcctatctcgatgcacgcaaggctgctattcaggcagatatcgatgcaggtacgcaaagcagggaagcaggagaacaatacaagcgccagtatgaagagcagatggccaatgcccgcggcgaggctcatgaaatactggaaagtgccaaagccaatgccgtacaggaaaaacgtgaaattctggctgccgcaagaggtgaagccgaagcggtcaaggaaaaagcacggaaggatatcgagcgtgaaaaggtacaggctcgtgcagaaatgaaggatgcaatcgtggatgtggcatttgaagccgcaaaacagattgttaataaagaactggatgaaagtacacataagcagtacgtggatgattttatcgagcatgcaggtgatgagtcatggcaggcatagcagcaaaaagctacagtgatgcactgtttgcacttgcacaggaggagcagaagctggatacattcaaggcagatgtatgcatgatggatgaacagctgaaggcgtatcccgatttcatgcgggtactgacgcatcccaagattcacaaggaagaaaagaaacagacgcttgcgtctgtattcggtagtgaagtcgatcatatggttttgaatttcgcaaagcttttgattgacaaaagccgttttcagagttttcacgatattaccagagagtttgtaaagcagtataacaaggtaaacaatatcgaagtggcacatgtccgtacggcaaagaagctggatgatgcggaaattaagcgtctgaaatccatgctggaggaaaagctttcgaaaactgtggaattacacatacaggaggatccggatctgcttgcgggactgcgcataaagatcaatgatatggttctggataataccgccagaagccgtatggataatctgaaacagctggcacagagtgagcctgtgcaggaaagttagaggtgagtgcgagtgagcttaaagccagaagagataagtaagctgatcaaggatcagattcgcagatatgatgaggatctggaaatcgatgaaactggtacgattatcaccgttggtgacggtatcgcgctgatttacggtttacagaatgcgatggccggtgagctgcttcgttttcccggagatatttatggaatggtactgaacctggaggaagagcacgtcggtgctgttttgatgggggatgactccaacatccgtgaaggcgatgaagtaaaacgtaccggtcgtattgtagaggttcccgttggggacggtatgctgggacgtgttgtcaatgcacttggacaggcaattgacggaggagaaccgatcaaaagtgataagttccgtccggtagagcgtgtggcacccggtgttatgacaagaaaaagtgtacatcagccgattcagaccggcttgaaaatcattgattccatgattccaatcggccgcggtcagcgtgagctgatcatcggagatcgccagaccggaaaaacggcgattgccattgatacgattatcaatcagaagaataacaatgtaaaatgcatctatgttgccattggtcagaaggccagtacggtagcacaaatcgtagaaaagctgcgttcccacggtgccatggagtatacgaccattgtatcctccaccgcaagtgaaccggctccgctgcaatatattgcgccgtatgcaggttgtgcaatcggcgaggaatggatggaaaacggtgatgatgtgctgatcgtttatgacgatttgagtaagcatgcggttgcctatcgtaccatgtccctgctgctgaagcgtccgcctgggcgtgaggcatatccgggagatgtcttctatctgcattcccgtctgctggagcgtgcggcaaagctgaatgatgagcttggcgcaggaagtctgacagctctgccaattattgaaacacaggctggagatatttccgcctatattccgacaaatgttatttccatcaccgatggacagatcttcttgcaaacggagctgttcaacagtggtgtacgtcctgccgttgacagtggtctgtccgtttcccgtgtaggtagtgcggcgcagatcaaggcaatgaagcaggtgagcggttccctgaaactggagctggcacagttccgtgagatgcaggcctttgctaaattcggaagtgatctggatgcggctacaacggaaacacttgcccacggtgagcgtttgacgaagctgctgattcagaatcagtatgatccgcttccggtaacccatcaggtgttatcactgtttgcggcgaaaaacaaatttctgaagccggttaaggtggaggatgttcagatgtatgaaaaagaaatgctgaagtacatggagcgaaaccatgcggacatcttaacggaaatcgaagaaaagcaggcgctggatgatgcactgagtgcaaacatcaaggctgcattgcaggcgtttgaagctgaattcaagaatatgatagaaggataatgtatggcagcaggtaaactggagatcaaagcgcgcatccgctctgttgaatctacagaaaagattacaaaggcgatgcagctggttgccaccagtaagctgaagaaacagaaacagtacatggaagagaatcgggattatgcatattatctgaaagaaactgtgcaggaaatcctgtcttccatcgagcattccagacatccgtatctgcagaagcaggaggggaaaccgtataccatcgtctttacaagtgacatggggctgtgcggcggctataatgccaacatcttccgtatgctgcagcatgaaatcggcaatgagggtgactttgtcattatcggagcacgtggagccaactggattcacaataaggatttccatgttgtgcaaagcgaaacggatctggaagaggactgttacagtgagctggttggtgtagctgatcatgcattggaactgtaccgcaaacaggaaatatcggaaatacgtatcttatatacacactttgttaattctgtaacctttgaaccgaagctgattacgctgcttccggtggaaaaggaagaacgagagaaagcaacgactgcagaaaccatctttgagcctacaggtgaccggattctggacaccctggttccaatgtatgtgcgttcccttttatacagctacttcctggaaacgaaaacaagtgaacaggcaagcaggcgtatggcaatggaaagtgcaacagataatgcagaggagttgaaggaaactctcgaattacaattcaaccaggctcgacaggccgcaattacccaggaaataacggaaattgtcggcggtgtcaacgctatggaatgaaaggagcagccatgagtaagaatacaggaaaaatcgtacaggtcattggtccggtagtcgatgttgcatttgagaacggagatctgccgcagctattgaccgctattgaaattcctctgaaagacagtgaatctttagttgtcgaagttgctcagcatatcggtgatgaacgtgtccgctgtatcgccatgggtggtacagacggtctggttcgtggaatggaagccattgatacaggatccgcaatccgtgtaccggtgggaaaagaaattctgggaagaatgtttaatgtccttggacgtgaaattgatggtctgggacctgttggaacggagaacacactgccgatccacagacaggcaccgggctttgaggagcagcagacatccgcagaaatgctggaaacaggaattaaggtcattgacctgctatgcccatattccaagggtggtaagattggtttgtttggcggtgcgggagtaggtaaaaccgtactgattcaggagctgatccataatatcgccaaggaacatggtggaatgtccgtcgttaccggcgtaggggagagaacccgcgaaggaaacgacatgtatcatgaaatgaaggacagcggtgtccttgataagaccgtgctggtgtacggacagatgaatgaatctccgggtgcaagaatgcgtgtcggcctgaccggtctgacgatggcggaatacttccgtgatcatgaccatcaggatgtgctgctgtttattgataatatcttccgttttacccaggcgggaagtgaagtaagcgccctgctgggacgtatgccgagtgcagtaggctatcagccgacacttgcgacagaaatggggcagctgcaggagcgtatcacatccacgaaggatggttccattacctctgttcaggcaatttatgtacctgcggatgacttgacggacccggctccggctaccgcatttacccatctggatgcgaaaacggttctggaccgtgatattgcggcactgggaatttatccggctgttgatccgctggaatccagctcacgtatattggatccgctagttgtcggagaagagcattatgaagttgcccgcggagtacagacgattttacagcgctataaggagctgcaggatatcattgccattctgggtatggacgagctgagtgaggaagacaagattattgtcaaccgtgcccgccgtgtccgtaacttcctgtcacagccattccatgttgcggaggtgttctccggaatcaagggctgctatgtatcccgtgaggataccgtgcgaagcttcaaggaactgctggctgggaaatacgatgaccttccggaacaggccttcatgttcgcatcaacgatcgaagaagttgtcgagaaagctaaggctctggaaaactgagtatgatcaaaatcaagatcattacgccgctgggtctttacaaggaaggcgaagtcggcggcgtgcatgtacggacggtggaaggagaaacgacaattcttcccaaccacatgccaatcgttgcaatgctgacaacatgcaaatgttctcttatggaaggcaatgaatataaggattatgcgattgccggcggactgcttcagtttgcggataatgaaatgcgaattcttgcggatgcgattgaaggccgtgaggaaattgatatcgagcgagccagacgtgcaaaacaacgtgctgaggagcgtttgaagaaaatggataaccgcaccagcattaagcgtgctgaggtcgcattggcaaaagcaattaaccgtatcaaggtttacggtggttaacattatagggatatcagaatcatctggtatctcttttttgttaagtgaagcaattgaatatatattataaaaattcatgatttgtttacttttcagcatacctgcaaaattagatgttatgctatggctacaggcaatgtataagactctaggatatagtgagttctttaactggcagatctatgatgcattcagcctgcttgcggttatcatgcaaagcgctggtaaacgtatgatcggtaattgagctggtgtaagtatgctgaatcttccgcaaaaaaagaaaagaatatagaagtctgtattgatacatccgggaaaagcagtcttactgaaaaggatatcactcttttcaataagcaatagcctaagcttaaaacaggtatccatattccaacctattgattttaactgttctctgacatgcttaaaaaattcgtgatgtagattctagcttgcggatgtagacgaaaaagggaatccaaatatctatgaaatacaacagtatttgaattcccccatgtatatgtattcgttatggacgaggtcctgtagaactataaaagtttacttccttcttctcaacctgtcaaagccaatttgtatgaggacaatcagaaaagcgatgagcatattctccaatgaggctgaccggttgaaaaccatcatgatcgccacgataaccgtatattcgattaagtaaatttttccattcatattcgttctcctcaaaatgctgcatgaactgtgcttccactgttatgcaacagcggcatcatatgtattcggatacagggtgatcatcatataacagatttcatcatcactgatctcaatttcaaaggcctcctcaatggacttgatatggcttcttattttctgaaaaatctctttattactgtccaaatagggcgtcttatggtcaaatatgattgtcttatttgctatgatacgctcaatcataaaaccgatatggataattaatgagaatccggtagaggctctgtttttttcttcatactccagatcatcaaaaagattttctaaaaactccgcggcaaccttctgaacagccagtggatttacatacataacatgctgggccagaaatcctgcagcttcctctgcactctggtctgtatttttatgctttgtcttttgttcgcttactcctgttttgttcagaaatttaatgaaattctcctttttatcattggtaaccagttcggatatatgaaagaaaggggcatccacatcaatatgtacatttccaatgactgcaatcagattgtagctgtccacgatttcctgataggtctcatttttcttttgaagctcctcattgcttaacgcaaatacatggatgtagccaagcgaattttcctttaatatttcaacaatcatatttttaaatgcgatacttgttccctgaccggatgaacatgcggatatgattgcaggctctttctctgagcttgcaaaggcaggctcaaagcggtttttaatcagatattcattataggtgaggtcaatatgctcattgcgattcagcatgatgtgcgcaaagtccaaagcaattgctgtggatacgtttggaatcgtatgtgtggggataccggtatctctggtcagcttatgaccaaaatccagaagagagcccatgtccgccagaatcatcacaccctttttgagatgcagactctcgatttcctccataaacagctggtagctctggttgacatcctgtgtcagcggcatatcaaatgcccttacaaaatccgtatgcagcaggcggttgcatacctctgctatgctggatgccgtattgccatgagcaagaatatataaggcagcctttgatgaattatccggtacaatatcacttgtaatattcttgatcagcagctgaaagaactttttctcatccgttggcagacgcagagaaaacttgctttcgatcctgtcgatcatatcgtcaacaatcgcatcgcctgttttcacaggcacggagctgctctccgtcagctttattttccgcaatctgtcaatgagaaattttaaatgaaaggccagaacgaggatgctctgctccgttatttttacagacaggcggttttgtatttccttcatgacctccagtgagaaatcgacaatgcgcggttcaataatcttataaagctcatccttgtttactgttttaaaatacatgctgttgagaatttcgtcataataggaagacactgcggaggatatgcgaattgcgacctcatcgctcgtcagtccctgtctggaataattgcgaatctcatcaatcagactgcagtatgcttcctcattcagtacattttcctttacatgtgtaatctcattggaaggtgtgattacaaggtcatagttgtaattctcataattgtcggtgaaggtatatccgattttcctatactttttataagcctctcggatattgtctgacagaaatacatagggaaccttgatttcaccgaattccttggttttactttcaaggaaagagcgggcacacagtatttttatttcagaggcaagctgtccgatattttctgtaaaatcatacagggtaatagctttcacaatatccgcatcaatgatataggtacgctgtgtaaggattgcctccttggaaaagagatgctccatgattttcagcttttcctgtagcggacgctcgcgcagcggcggcagattgattgtaagcggaattctgcgcttaaaggttttcagcaggacatccttcggattttctgttgtagctccaatgatgaggatatccgctttccgtatcgtatttgcttcccccatcttgcggtactgtccggtatccataagatagaataacagctcctgtccctccggaggaagtctgtgaatttcatcgagaaacaatattccgtgattcgctttttcaacaagaccctccgtttcctgatccgcgccggtaaaggcgccccggatatgtccgaacagctgtgacagtaaaagctgtggattgtgatagtagtccgcacagttgaattccacgaagggatattccttttcactcatgccttttatttttctgccatagtcatacatcgtatgcgcgaataatgtttttccagtgccgctttctccggtaatcagtgtgtgcagccccttgggtggatataaaattgcggactgcgcctgcttaatctgtaaagactggctgccgtcatagccaatcatgatggaaaaggaatctgcctcctgttcttttttgaaaaacagatctctgatttcctccggggtataaacactcttttccaggtgaacatgcagctccttctttatgatatccacaggaacaaataaaacaggtcgggtttcgattttaataaacaagccgttcttgacagccgtattcagcatggtactgaccgtcgaacggtatgtgttaaagtgatcagcgatatcctttgctgtgattccgaaattctctttcttctgaattctgttttccagatattcccttgtaatgacagaatagatataatcgaatacttcctgctcagacatatctacacctcttttcttttatgaatgcatcgtttgttttaccatgatgcagcagtacgtttattaatgaatgtgcagtttgccattgtgcaaaagagcactgcaaatgcctttctctattgtattgcatgatatctgtgctttgtttctgctgtatggaaggttgcagaaaagtacagacagcatccgtttaggataaaagctcaatcaatgagttcataatctcctttggcgttgtggaagctttaatccgctccatggattccttctctgaaaacattccgacaagcttttggagaattgtcagctgatgctcagcaccattcacagcaagcgtaaagatgatatttaccggtacggtttcattatctgatcccattagcgtgaaatccacaggggttttcagctttgtaatgatgattgccgatttcttaaccgtatccctttccatgggatgagggattgcaaccttaagtacctccgtgggtaatgctgtcgggtacagcttttctcttttgataactgcatccgcaaacccttccttaacatatcccttccggtatgcatcctcaccgatttttttgatagcatcctcaaaatcctctgcttccagtgttaattctatcagttcttcaaataataaatcccttatattgtatttttccataattgaatacctcccgctttttattaaagcaaaaatcttgccaaactatggaattataagctgattatgaaatatatctgaaaatttatgagaaaatgcttcccttaagctcctgtttaccaaggctgaaatttatcactatgcttatgcagataacatgcagaggttgtttgtgataccatagggacatggaaaagctatgatttacagagcatattcgttcgtgattgaaatctcatttaaaattatagcatagaaaatataaaagaaataataaataaatgcagttatctgtaagcatgcatgaaagggatatacgttataaaaagagcgttggggaatttgggttacatatataaggaagcatattggaaaaacagccattctgtaagacataagaagaggcaaaaaagcatttttgcatatagcttccctatgctttctccggtgtaaaaacagaagaaaaagtgtctgttcactggaattggcaaaatttttgctttattaaataggcgtaaacgacctgaaagatggttagaaaggagaatgagatgaaaacaattatcgttgcttgcggaggtggtatcgcaacctcggctacatgcgctacaaaaatcaatatggcgctggaagaacgcggattgagtaatctggcgaaggccgaggctgtcgatatcaagtcacttgataatttcatcaagactgcagatgtctatgtatccattaccccgatgcgcggtgtggtacaaagctatgacattccggtaatcagcgggattccgctgctgacaggaatgggcaaggatgcctgcattgacgagattgtcaaagcattaaagtaaaagaaaagaagaggagaaaaaaattatggaaatgttagctaccgtattccagggtcttctggacctgggcgctgccgtatttcttccgattgtgttattcattatcggcttgatcgtaggcatgaaacctggcaaggcgttctcatccgcattgaccttaggtgttgcatttattggtatcaatttattgattgggtatatgggggataccgtcggggctgctttcacaacaatcgttgagggatcagatagtacattaaagtatatcgatatgggatgggcaccggcccttggacttgcgtggcagtggcagtatgcgttcctcatgttcccgatacagattgccatcaatgttatcatgctgctgctcggatggacgaactgtctgaatgtggatatgtggaatgtaggaaacaaggtgtttacagccttccttgtcacaagtgcatgcaataatgtgattgttggctttatcgttgctattgtacagattatcgcggaattaaagaatgcggattacacgaagtatcagattctggagcttaccggtgttccttctgtaggtatgccgcactgtatgtttttaagtaatatcttcttctatccgattgcaaatatactggataagattctgccaaatacaaagacgttgaatgcgcaggaaatacgtaataaaatcggtatcttcggtgaaaatcacgtacttgggttcctgatgggaaccattatcggtcttgcggcaggacagggttccggtgcattgctgctcggtgtacaggcaggtactgcattgaccttattcccgatggtttccaagctgtttatgaccgcactgacaccgatttccgatgcggcaagtgaatgggtgaaaaagaaattcccgggccgtgagctgatcattgggcttgactggccaattctggcaggtaactctgaaatctgggttgccatcattctgacaattccggttgcattgatcttctcgctgattctgccgggaaatactgcgctggttcttggaaatctgatgaatgtctgtgtttgtgtaccactgttcctggcaatgaagggcgatgtgctgaaaatgtgtatcgtttcctggatctggtgtccgattttaagctacgcggcatccgttatgggaccgctcctgactagtcttgcaaatactgccggaacctacaacaccgatatcacatggtggggctgcgatattgcggaaatccgttttgcaatatatgaagcagcaactggcaatatgatcggtatcgtggcatgtgttgctgttgtggcactgggaattctgtacttcctgaagctggcacccgcaagagaaaaagccgcaaaggaacgtctggaatccggacagtaaaaaagtgtctttccttctgtatgttgtaatataacctatggaaaagcagcttatgtcgctgcaaattgacacagtatctatcatagtaatgcaataagcaaaatgaagaatgaggtgatcctatgagcagatttcaacagttttggtggtatataggcgtttgtatgacagctgtcgcgcttcttttatcagtagtgacacgcaactgggtgctggcaatactctgcgccgtttccactgccggactgcgaaaattaaatgacaaggttgaattaccgaaggtatatacgcagagggggattaaaaatgagtggtttacaccagggagacaacagaaatgaaaaagataataaataatccgaatgccgttgttgaagaaatgctgcagggtattgaaatcgcgaatccggatgttttatatgacagggaaggcgtcgtcattgcccgcaaggaaaaaagtgataaggtcgggcttgtatccggaggaggcagcggtcatgaaccggcgcatgccggctatgtcggctatggtatgctggatgccgcagtgagcggtaatgtgttcgcatcgccgtccccggaccgggtgctgcgtggaattcagcttgcagactccggtcatggtgttctgctgatcataaagaattatgccggagatatcatgaactttgaaatcgcagaagagcttgccggcatggaaggtatcgaggttgatcatgtcgttgtgagggatgatgttgctgttgcggaaagtgatgaatctactggcagacgtggtattgcaggaacagtattcgtgcataagcttgccggtgcgaaagcagaaacaggggcatcccttgccgaggttaagcgtgttgcggaaaaaacgattgagaacgtaagaagctttggtgtatcgttatcagcctgtacgattccggcggtcggcacttgcggctttacgattgaggaggactgcatggaggtcggtatgggcatccacggtgaagcaggtattgagaaaacgaagctgaagccgtcaaaggaaattgcggatatcatggtaaacagaatccttgcggataaggactatggacatagcgaggttgcagtcatgatcaacggtctgggtgccactcctttgatggaattatatattctggcttctgatgtgcatacccggctatgtgccgaaggtctgaagccggtcaaatattatgttggaaactatatgacggctattgaaatggcaggggcatcctgcagtatcctacagctggatgaggaattgaaaaggctgctggagtatccaagcaataccccggcatttaaggagattggataatgggatttcaattacagacaaaggattttatccgctattttcaggaagcccgtgaggtgattgctgcgcagagggactatgtcacggagctggactccacgacaggggatggcgatcactgggtgaatgtgaatatgggatttgaaaaaataacagctctgtcaaaggagctggaagacatgacgctggcagatatgttcaaaaaggttggaatgacaatgtattcagctgtcggaggctcctccggggcgctttatggcagcggatacatggcggccggaagagcttgtgccggcaaagctgtgctggatgtacacggtctgtatgaggtgtatgacgccatgctgcaggaaatcatgaagcgtggaaaaacagagcccggacagaaaacgatgattgatgcattatacccggcacttcgtgcatacagggaaggattggacgcaggcaggtgtgatgaagaaatcattcaggattttatggaaggcgccgcaaacggtgcgaagcgtacaaaggaaatggaagctgtaaaaggaagagccagctatcgcagcgataagggcgtaggacatctggacccgggagctgttacgatggcaatgcagctggaatgtatgggaaatatgatattgaatacattgaaacaaaaaacaggaggagatacttatgatgaagaaaatacaattttacgcacccggtgatatccgtgtggaggaggcagaaattcctgtaccggaagcaggagaaatcgttattaaaaatgaggttaccttaacctgcggtacagacgtgaaaacgtataaacgcggataccgctatgaaccgccgttcggcatggggcatgaagcaagcggtgtcgtatatgccgtcggtgaaggggttaccgggtttaaagtcggtgatcgtgtggttgcacacaattctgcatcctgcggaacctgttactattgtaaaaagggacaggagtccatgtgtgtggatctgattcagaatcagtttaccaacggagcctatgcggagtatcagctgattccggaaagaatcgtcaaattgaataccttccatattccggaaggaatgtcctataagcaggctgcactgctggaaccgctggcttgtgccttgtatggaacggaaatgacgaactttgatctcggtgactatgtttgtgtaaacggctgcggaccgatcggtctgatgtttgtacgtatgtgtgtattgagaggtgcacatgttatcgcctgtgatatgacaccggaaagactggcacttgcgaaaaagctgggtgctcaggagatcatcaatattaaggatctcaacggtaaggatcaggcagaggcagtgaaagagctgacaccggatgcgcgcggtgtggatgcggcaattgaagctgccggattaccggaggtatggcagattgctctgcgtatggcaagacctggcggagaggttctgttcttcggcggtacgaaaaaaggcctggaggtacctgtggatacaacgcttgtacactattctcagctgacattgaagggcgtgttccatacaactccacagcatgtaaatgcagcctttgaaatgttgaagatgggggcaatcagtgcagaggattttgtacagaatgaatactgtattgaggatactgaaaaggcgattgtcgagcacgctagcggtaaggttatcaaaaactgcattgtatataaataaaaacacagggaattgaaaactgcgttttatggatgtataattcaactatgaaacagtcattggaaattatacaaaatcagaagcagaaattctcatcgaagctcgtaccctcaatggaaatccttgcactttctcagcatgagctggagtccctggtcgatgcaagtctgatggataatccgttctctgatgttgatcagaatacaatatccttaaagaccagagatgtcgatttggattttaagcgggttcggaaaaagcagggtgagcttcaggagattgcatatgcggatgaaagtcaggatgatttgttcgagcatgtcatcgtgcagctctatccgcatatgcagacaaaaaaagatgaagaggtttttaccgtattattagaatctttggattccagaggatttctttcagaaacaccggatgatttgtgcagattcctgaatataaagaaggcaaggctgctgcagtatttgcatgtcctgcagcatgtggatccgaagggactgggcgcaaaggataccggagaatgcatatgcattcagttatcggaaatcgaaggctccactctggcacagcatatcgtatgttctcatctggaggcactcagtacaggagattttttgaaaattgcgaagtcggagcataccgatgtggagcacgtaaagcaggcgttgtcgctgattcgttcactgaatccaattcccgcaaacggctttagagtacgggagaagacggtgtttatcattcctgatgtgtatataaggaaagaagattctacgtttcttctggaaatgaacgccagactgcaggataagctcagtatgaatacggaaaactatgagctttacaaatcagcggcttgcaatgcggaagcaaaggcctttctgaaggaaaagctgaatgattttaaatggcttcaatatagtatttccagaaggtcggtgacgctgaaaaaaatcatagcctttctggttgaatatcaggccgcctttttccagacaggagatgaatgtgcattgaagccgctgcgccttgtggatatcgcagaacagctaaaaatgcatacctccaccataagcagagcgatttccggtaaattctttcaatgtgaatatggaacctactcctttcactttttagtgccgagatgctatgaacggcagggagaagtgacagcctccatagatactattcgaaacgagattaaggaaatcatccgttctgaggataaacagcatccctattccgatgagaaaattcatcagctgctggaggaagacggatttgtgatatccagaagaagtgtaaccttataccgaaaggaatgcggcataccgtcctcacggaatcgaaagactatccatatatagaaaggatcgtcataatgaatattttagacgtagcatttgtagaagaactcgttgatgcctgccagtatttctgggaagcaggatggggagaatatcatgcaggaaatatcagctatcttctttcagatgatgaatttgatcagctaaaggagtatatgcaggtgtcggcatctgttgatgttgcctttgacacagctggcttaaagggaaaggcatttattgtcacaaaatccggagcatgctttcgtacaatgaagaaaaagtatgaacgggatctgggaatcattcagttcaaggaaaacggatatgatattctgtggggacttgatcagggaagaggaagaccaaccagcgagcttcccgcccatgtactgtgtcatcgtgcaaggctcgcagatgatgcaaacaacaaaattgtaatgcactgtcatcctacctacctgaatgcaatgacgatgattcatgagctggatgaggaaagctttacacagaccttgtggaagatgaattccgagtgtgcgctggtgttcccggaaggactggcagtattgccctggatgaaatgcggagaaggtccgatcggtccggcgacagctgataaaatgaaggataaaagggtcgttgtgtggccgttccatggtatattctcgagtggcaattccatttcggatgccatcggcttgattgaggcaatcgataaaaatgcgcatgtatatgttctggtgaaagccaatatgatgcatggaatgaccgatgaaaatgtacgggaattgaaagaacatttcggactgagctgatttcttcagctttcgattatggcaaggaaaaggagacagcaacttcttttccttttgtcatagaggaaacatatgtctcattagatagtgttttgatcagcttctttcggaatgaaagagaaggatatgaaaaggagaggacctcatatgttagagcatttaaaaaaggatgtttgtgaaatagcaaggcgtgcgcagagggatgggttatgtaaacacaaatcagggaatttttctgcccgtgatgcgaaaagcggctatattgttattacaccgaccagtattgatcgcgaaatgctgacaccccgtgatatgattgttatggatctggatgccaatgttttggagcatgcatccggattacgaccgacgagtgaagccttgatgcatttgatgatttataggacgagaaaggatgcgagggcaatcgtgcatacacactccatgtatggcaccacgtttgctttgttgaacaaaccgattccggcaatcgtatatgaggtcgcaaatttcgggcttaccaaggcacgtattccggtagcaccctatggccgccccggtacgatggagctggctgattctgttgttgaggtctgtaaggaggcggaatgctttttactggaaaagcatggtacggttgcttttgatacaagagatatttacgaagcgtatttaaaggccaattacattgaggagctggcacagctgtattataatgcgctgacagtacatcagggaaaggaaccggaagctttttcacaggaggagctgcaatgctgggagtatccaaaggaaatcagcttcgctgatgaataatgtcagtcagttttagcgcggaggaggattctctataggttaatgcgcccttgtgtgttatatggaaatgcataagggatcagatatgtatgtccgtgctgtgtgtgtcatctgatattgcttttcaacagaaaatgcaggcatgaacaatataggaagtgaaagcccaattctgggctttttcttgtgtatggctgcatcgtatttcgtcggcacatatacgaaatgtttgaaatacgcagaaatccaatgcgaatgctgtggataagctggaatcagtctctgcccttgtgacaaaggctgacagtatgctacaagatatcgtctgtcacagctttttaacgatacacaaaagtatgaatttgttttatcgtcaacgtcagctttttccataggaatgattcagaaagcttgatgcaaatgtaaatcattgtttctttgaacaactaattcctgcttcatatatgtttatttccggaatctctctctaaaatgaaaaatattcagaaaatagaattgtgtttgttacaaagttacggtatactaggaaacagcgaggtgacatcatgagagtattgctacagagggtacagcatgcaagtgtgcgtgttgatggagctataacaggaagtatacagcagggatttctgctgctggtgggaattacgccgtcggataccgaggacatcatgaggaagatggcaggaaaatgcgcacagcttcgtgtatttgaggatgaaaatggaaaaatgaacagagggcttcaggatatcggtggcagtattctttctatatcacagtttacgctgtatgcggattgtaaacggggaagacgcccgggatttgaaaaagcggcacgcggggattttgcacagccgatgtaccatgcatttaatgaagagctgcgtacttatggtatccatgtggaaacggggatctttggtgcggatatgaaggtggatttactgaatgacggtccggttacaattttgctggacagtgaagaatggtaggaggaagtgtaatgggcacaattttatatggaagtgaaatagcgaaggatatacgtacctcgttgaaggaacagattgatgagctgcgtgagaaaggaaaaaggattccgaagcttgttgtgattcttgtaggggataatcctgccagcctgtcctatgtgaccggcaaggaaaaggcgtgcagagaaatcggaatggaaaacattctgctgcggctgcaggaggataccacagaagaagcgcttctggcggaaattcacagattgaatacggatacctccgtagacggtattctggtacagctcccgctgccaaagcatatggatgagcataaagttctgtttgctattgacccgcaaaaggatgtcgatggctttcatccatataatataggaaagctgatgctgcaggaggatacctatctgccctgtactccaaagggaatcctgcgtatgctggacactgctggatattctgatttaagcggtcttcgcgcagtcgtcatcggccgcagcaatattgtcggaaagccggttgcgcagctgctgttaaaccgcaatgccacggtaaccatatgccattccaggacaaggaatatcgaagaaatctgtgcggaagcggatatcctgatcgcatccgttggaagtccccgcctggttacagctgactgggtgaaaaagggagctgttgtcatcgatgtcggcattaaccgtgtggatggcaggctgtgcggtgatgtggattttgagacagtgaaagacaaggcggccgtaattacaccggtacctaagggcgttggaccgatgaccattgcaatgctcttggaaaatacgctggaatcctatcggaaacacagctgatatgctgatagaatttttgggtgagatactggttgagggagtggcatatgggacctacggtctgatggagctgtttcttgacagcctgtataagggttggaacaaaacgctgaagaagctgctgtgtgtgcttatgggaatcaccatgtggattctgatagggtatatgatcatcggaattctggaaattgtcttataaatgtggaggtgcttatgatagaaaaagattatgatctcaatgatatcgtcgaaatgaaaaaggaacatccatgtcataaatcaaaatattggaaaattatacgtatgggggcagatattcgcattaaatgtctgggctgtggtacaagtgtgctgtttcccagagtgcagtttgaaaagaaattaaagagaattatagaaaaggctcccggagaaacgaatgaaaactgacatcctatgtgatgtcttttttataaggtaggggaaagatacaacagcgccttatatttataataatagcaaggacaaacctattcaaagtattaataaaatatgaatgtaaaatataattgacataatagaaaataaagcatacaatgaaaggggagaggaagtggtgcaatggcgaaaaatctgaaattgaaggctgcgagagcagcgatggatctgacacaggaacagcttgcagaaaaagtcagtgtaaccagacagacaatcaatgccatcgaaaagggagattataatccaagtataaatttatgtatcaccatatgccgggtattgggaaaaacactgaatgatttattttgggaggagtgaagattatgaaaaactttgatgaacgacaggaacaggttcgcggcagaattatgactcgtgccttcctcataacgattatactcatgttactggctgcatttctaaacgatatgcatctgtatgatttcgaaaagaatgtcggctttggagaaacgttgatcagtattgtctgtattgctataacatacggttctgtggcaagtattttaagcaactcttattttggtccgctgaaggatggcagaatggcgtttattgcttatgtatttaccgcgttgtcggtcgtgctggcagccttgacgatctttgatctcattcgcggagaaaaactggtagttatgaatatcatttccctcctgatggtgtttagtatcagcataagtttgtggatccgtaagtcagattggaagaaataacggattccccgtatttgcttgcatatatgcgaaaaaaacgataaaatggtaaagcgagaggaaggatagtatatgccattaactgcaggaatcgtcggattgcccaatgtcggtaaatccacattatttaacgccattacaaaaagccaggttgaagctgcgaattacccgtttgcgaccatacagccaaacgttggagtcgtggaagtgcctgattatagaatcgaccgtctggtggagctgtttcacccaaagaaaaccatttatacaacctttgaatttacggatattgccggtctggttaagggagccagcaagggagaggggcttggaaaccagtttctgagcaacatccgtctaacggatgccatctgccatgtagtacgctgctttgatgatgcggatattacgcatgtcgaaggaagtgttgatccgatacgtgatattgaaatcatcaatctggagctgattatggcggatttacagacaattgataaccgtttaagcaaggtggagcgcaaggctgtcacgaataaggacaaggatgcacttgcagaggttgttgttttgaagaagctgaaggaagcgctggaggccggaaagcctgcgcgaagtgtagagcttgataaggatgagctgctgctgattaaggcattcagccttctgactatcaaaccgatgatttacatagcaaacatgtcggatgaggaaattgccgatccgcaagccaatccatattttcagaaggtgaaggagcttgcaaacttggagcataatgaggttgttcctgtttgtgcgaagattgaagaggagctttcagagctcgataaagaagagaaaacggagtttttgaacgagcttggaattcaggaaagcggtcttgataaggtgataaagacagcatatcatattttggatttatgcaccttcctgacagccggagaggatgaatgccgggcatggacatttcatcgcggaatgctggcaccgcagtgtgccggtgtgatacacacggattttgagaaaggttttatccgtgcagaatgctataagtttgatgacattgataaactggaaactgaacaggctgtaaaggaggcaggaaagctgcgtctggaaggtaaggaatatgttgttcaggatggagatgttctgcatttccgatttaatgtttaggaaacaaagcacctgttgatgcatttcatttatcatatgtaaaaagaggtttcatcccattgattgtgtagaataatccgggaagaagcctctttttgcctgttttaggtcaatttttctgtatattgatatatgatttatatagtattcaatttatagaatatcatcattttttaataaaacttgctatatcttcaataaacgcctgatttacatgaccctttgttttgtactcctcattcgtcggtgttccttctccatctatcataaggtgcgttgcgttcggataggttgtgaatttccagtttttatgcgtttcaaaattcttcctccagattgcctgatcttcttctgtgacctgataatcacgcagaccctgtgcacataatacagggaccttgatatccgcagcctgctgaacagcatcataggacagcaaatccttcatataagcctttgacatacctccgaaaaatattttggcatcactcagctcatcaattcgctgcagatcctgctgatcctgtttgtactgatcgatagctgcctgttcgtcctttgttatgtttccatccagctttgccagataggtaacctgttccatcagcagctcatccaatgctcttgcaggggcagccatcatgatatagcctgcacagccgtccgtttctgctgcgattcttggaatcagatagccggagagactatgccccaggatatagattttatttgtgtcaatctgcttttgctgcttcatctggctgaatgctgccacagcatcgaaaattacctcctgctcgaccgtatccttcactgtaaaggattcaggatatgtgtaggttcgcttatcatagcggtagctcgcaataccctttttcgcaagtccccaggcgatatcctgaaacggtttgttatcgtaaatggtctcatccatatcattcggtccacttcccgccagaagaattacaagcggaaagcttttaccctctgccggagttgtcagtctgccgctcagcttttttccatcggcaatttgcagctcaacttcacgctccttgacaccatccggagctttcgctgctttcttctgtgatttgtacggcttaaagaacaagccctgaatttgatcctgttcattcaggctcacctgaatattggtattctgttcctccatacggcatggtatcatgatgattgtcgaattttgatagctttgtccatagggctgctctgcctcaatcagtgatccgagactgtcattataggcatccagctgcttctggaaggaatcctcccgtacagccttatgcatttgctcatcatatgcataatccttctgcagcttatcatatttgcgctgcgtcagatcctttacaaactgaagtgccatatcactttgcttgtcactcagcacgatatccgcaacctcatcggactgtcccttcttctctttttcgccgctgcaggctgccataagaaaacatagcagacagcatatgacaatttgaattttctttttcatgttttagcatccttttttttcattgtatcacaatcgtgaagaaaaaaaagaccgaaggggtctaattttcatttgctataaaagacttcaattcctcaaagctgtttttggcatccatgtagccctgttcatataattcccgcaatctggcttcatttttctccagacgcgaaatttccacgggagagcttgggcgtatgaggaagacacttccttccttttccattaaagcaagctcatccagtgtgcggttataggcgatatggcgtgtttccagcgccttgatgaatttcggatacttcttatagctgcggcggatcatcggcagcagattgttttttcctttgcggtattctttacactgtgtgagtacaactatattttttgtatatcccatctcctgaaatttatggatgggaatgctgtctgttgcgccgccatccagcagcttttttccatcaacttcgacgattctggaaagcaggggcaatgatgcagaggcacgtacatagataacatcacgcttcatattgatacactgcaggtattctgccttaccggtttccagattgctggcaacggcatacagctttgtatgcgatgtattaaaggcatcaaaatcatagggatccagtgtattcggtatatcctcatacacaaactttgctccgaagaaatctccggttttcagcagagaggatacgctcatatagcgcttatcctttaaataggcggtattggtacggtacgctctgccgatctgtttggatacataactgcacgcatgacaggcacctgcgctgacgccaatgacaccgtcggtatataaattctgttccataaagaagtccagcacaccggcagtataaattccgcgcatgccgcctccttccagaacaagtccaagcttactcattctcttcacttcctttatgacctgtatattatagcacagtttctacgtacttacacacgaaggtaaaaatcaaaatggcgttatcagaggaaatcgtggtgtgacaataattttacaggcaatatccatatttaggctgaagtgaaaagttaaattccactttcaaaaggcgaataaaaaatgtggaactttcttctacagaagtctatacagagcataaatatagcgttagaaagggtttcaaataggtagaagtaagtaaaaatgtgaagaaagtggtcattgtgcgaatgatagataaaatgaataagcgcactgaaaataggctccattatgcctatgtataactaaattccacttctattttatagttacactataaataactgttctttgccgctgctcttatcattctttatatcatctgtttgttacttatgagtcaatacgcttggacgaagtatcacttcgtccttatctattttctgtagaccaaattcataaagtttctgcgctaattccggacacatgaactcacatagctcaaatggggattttccattcaaatgttccttggcactggaattgatatgtgagatggctacattcaaggaagtctgatcggtcaggccgatactgcataagtctacttcgttaggcaatatataacgtaattcacgatgcatattttccaggcttcctttctgcccggactgcatagggtcgcaatagaagactcgtgtccttctggtaccatcgtctcttttttccatatgctcagcatcagtaaattcacctccgcgatcggtgagtgttatatgagcttcctgttcaaacaggctttttccaaggatggaatcaagaacagctagtccgtcaaccatatctgcagcagtcttcgtgtcgtgatatacagcaaacaggagcccatatttgatgaatttgaaagtctggataaacggtccattggaaatgtcattgtagactgtatccatttgtaaaatgtgagtgatttcctcagactcaacataggattggtaatctgtgtaaagccgtccaacaaggaatttacggtcttgtcgttttttatagatcgtcttcttcttagcggtcatttttcttttgacttttatacgaaggtcaatattagcaatgccaacacattcgaatacaccttgttcaatatagttgtagagtgtcttctcactgattccaagttcgggatgtgcagctatgatctgataaggtgaatgaccttttaatataagaggcttgatggtattgcctagctctacagcttctgatgaggtcagattgattccggttcgagactcaacgagttcgctacggtattcctcataggcgatcgtaggtttatagaggtatttatcaaagcggcagcttttcagtttctcacagccattacaagctcccggagtacgatctctgcgtttgcagcggaacttagaataatcagggcagttgacagtacaattctttctcttaaacttacagtgagcatagttctcacattctagagaaagtgtagatttatgagagagataacggtgagcacggatttccttacctatcgtagatttatctttgcctagattatcagcaatagcttttttagaggaaccattaacgatgccgatcgcgatgacattgcgatcgtcctgagtcagatgtttgtttttgttcgttgccatattcatcaccctttgtaatgtgtatgataataaccagcggttaccttcatcatagatataaaaaaggatatatgaaagactaaatgcaattgtaagtgtaaattcaactagattgttgtgtaagagtcttttctacttagctactttgaaagtggaatttaacttttcacttcagcatatccatatttagttcatttagggtttgtaaatacgttccataagtgataaaattagcatataacaagacgagaggagagcgtgtttatgaaactaattttagcgattatgtccaatgacgacagtcctgcagtttccagtgcattgacaaaagaaaattatcaggtaacaagactggcaacgactggaggattcctgcgtgcaggaaataccaccctgatcgtaggtaccgatgacgataagattgaacgtgcgattgaagtgattggagaatacagcagacgccgtacggaagtggtaccgagtacagcatcctacgacatcggaagatatgcatctttcccggttgaagtacaggtaggaggcgcaacgatcttcgttatcgatgtagaaaaattcattaaattataatgcaaaaaggaacctccgggtttctttttattatgctttcaggtggtgtgaatacacaagcttataccctttggatatcgctgatttgcatgtttaattctcatttatgattgtgatgatatataggtctaagcttacgtatccagcattataatatttattaacatccgattacagaaaacgggtatacttgtttagaaatgcagaaaaaaggagcttccttattcgatgaagtgccataagaaagctctttgttttagggttgcttttgtatatcggctgtataacagttcctgttttccgtagtaacggtatgatacgctgatgcctgctgtgtctgtttcatattcgtcatctgtccgtacgaaacagccaggatgttgcctagtctgcttttcatggcagctccttttggaaaatcagctccaccttgaacaggtcggcatcaaagctgatgtgcatatgcccgttttgcagcactgtaaagcttttggctatcgcaagacctaaaccgctgccctccgtattccttgccttatcgccgcgctgaaagcgttccatgatatcgccagggtcaaagtcaagctctgttgcggatatatttttgacagatatatatacctcctgctcgcgttcctccacatagacatacacacgggtatgctccaaggcatattttcctgcattcaccagtagattttccaatatgcgaaaggttttttgaggatcaaggctgagaacgatcttctctttactgaaagtgttgcgtatcgtcaggtcatgctgaatgaatagtgcctcgtattccatttccacctgcttaatcagagaaattaaatcaacatccatgcgatccagctgtatgttgcctgtgctggccttgctgacttcaaataaatcctcaatcaagtgctttagacgattgctgccggattccagtattgtgatgtaacgcagccgctcctcttccggaagattcttgtttttcagaaggtcgatgtagctgatcatggaggttagcggagttttcaaatcatgagaaacattggtaatcagctccgtgcgcatattctgtgagcgaacctcctgtgcaacagcctcctgaaaggatgtctcaatattctgaagattgtccttcagtgattcatagatgcccaaatcttcatccacagtggtttggaagtcaccatttgcaacgcgctgaatactgccttcaagcgactgaaagtctcgtttcatcctgctgttttgtcgatgccggatagaatacaggatcagacaatagcttgaaagcagaagatagaaaaatattccgctgtcccggtagatacatactatgaggatacatacgatatgcaggaacaaagcggcgagcaggcgaagctctcccttatcatgaaaatcaaagccgataatatagcgatacagccgttttgcctgtctgccaagcaatacggaattttgtgttagcagggagtgcttttgcagggatacccgcacaccgttgtgctgtatggagcgaatcgcatagccgcatccggaaagcactgcgaacagtccgcttaaacaagcaatctgcaacagataatagctggaaatctgccatgtatcggctgagagaatatccagtgagaaatcctccggcagacgaaacatccggtacacaagctcgctgcccctgattttatagaaataaagtccaagcagtgcagcacccagcgtgatttcatagggcagcctttgtgtaaaaaaacgatagaagccgctttttaccgcccatttatatggcataagcaaagaccatgcaaaaagcagtgtgcctaccagcaaagtaatgcgctgcagggccggctccatatattcctcaattcgggaatattccatgggaatggaatcatcagccggttctttgataaatgtattaccactaaagtcccgttcctcttcgctgttaatgtatttgtaatgcgttttgtactcttcgatggctttttgatcaagggatggaaataccagaaacatagatatgattgccagtgcaataccggacagaagaattagggtagtccaatgtgtttttttcataattcacctctttttactgtttctcaatcttatacccgacaccccaaacaaccttgatataacggggagcacggggattgatttcaattttctctctcagatttcgaatatggaccataacggtttcggtgttgactgcggtttcgttccatacatgctcataaatatcatcactggaaaagacctgaccaggatgctccataaacagctgcaggatccgaaattcaatcggtgtcagccgacgtgattctccatccacaaagacctccttgcttttgcgatgcagttcgattccacccagaagcagcctgtcctccacctcctgcttttgctcgagcagctgctgatagcgcaaatgccgccgcagctgtgcatgtacacgggcgagcagctccatcgggacaaacggctttgtcacataatcatccgcaccgatattcagaccggtaatcttatcaatatcttccgatttggcagataatatgatgataggaaactcatacagctctctgattttcattgtcagggcaatcccgtccattaccggcatcatgacatcgatgattgcaagatccaccgtattgttttgtaatagctcccaggcaatggctccattcgctgctttcagggtctgatacccctggctttttaaataaatttcaatagcatccgcaatcgatgcctcatcctcggcaattagtatgacagaactcatgatgacactccttttttataattatacaacagatatgtgctattttcttgttttttcataaaatgcaacatatcaaaggtatgcagacagattaatccggcaaggctgaatccgataaacagtatcatgatatccagtatgttcataatccgtcctcctgaagcaagtatatcgaaaaagtattaaggaacgacggcatcaattcaaaagattttctaaagaagtccgggtatttgcttgtaaaaggcattccaatgaaatacaattaaggaagaaagggtgtttgtatgaaacgaatcattgaaaatataaaatttatgcaggatggcaccatggtgtttggtgatctgcatctggaagatggctttgtggaacgaattgattataaaacaccacatatggtgagtgatatagcaataccggggttagtggatattcatacccatggctttcacggctattcctgtggaaatacagatatcgggaatctgcatgcgctggcgctggaatatccaaaacgcggaatcacctcattttgtccgacggtatcagcaagatcactggatgaatttcgtacgatcatcgacgcatatcggaaagcctttcagggagattatcggggagcacgctacgagggcgtgcatctggagggtccatatttaaatccggatcgccgtggttccatgaaaaaagaaaatcttatggaaattcatctgggtgagctggaggattttctatcagagtatcatgatgatataaaaatcatgacaattgctccggatgtaaaaaatgccatggaagcaatctcgttactgcatctgtatggggttgagatttcactggggcatacgaatgcagattttacccagaccaatgaagcgttcgcatgtggagctacacagattacacatctgggaaataccatgccggaaatcacacatcacaagcccggtatgatggatgccgtattcttatccgactgtctgtgtgaagttatcatggacggcgtacacatgcagaaggagatgctgaaatgggtgattcgtctgctgggctgtagccgtgtggttgcggtaagcgacggcacgcctttttctggctttcattatccggacggctatgagctggaggatggaagtgttatacgaaacggcgctgtttataaagaggatgtactgctgggcagcagctgtgacctgctggatatctttcagtatctgtacaagcaggagggctatgatctgtccgactgtatccgtatgtgttccaccaacgctgcaaggatgctgaaaacctatgcccatgaaatcggattgggaaaaaatatcaatctagtgattctgggacatgatatgcgtgtgaaagaagttattatcaacggaagaagtgcgttatgaattttatggaaagatgctgtgaaggctttgcatagcttacgggaagtgtttatgggaatataaaagggctcatggggtttttatgaaacctgtcatgagtcttttattgtggatggaatgcaaaggcagaaaccggcaatgcgatacctgagctattatttttccaggcttatgaagcagaaatagagattctatgaatcgttaagagtagaagaaaggatgacagggagagttaagaaatctaatgacgcttataaactcgttttaagaggagtttgtattgctgggaatacaggaatcagttaattctcttaaaacgctctaaaacgaataaaaatggggatttaagaaaaattaagaattgaccggagagcagagatacaaaaaagaaggcatttgccttcttttttacacaaattatttgtttacgcggataaatacaggaccacttccgatataagcagatgcttcaacggtcgttccgcccttccatccaccatgaacagcctgtccgttaccaacatatacagcgatatgaggaactccggcaccggcatcatcatagtaaattaaatctcccggctgtggactgcttgttacgctacccagagacatatactctgccggccagccgtggaaatagattccctgtgctgccagtgcattggaagccaatgctgtacagtcctgaccaacaccaagctgagccagtgctgcagaagcgattccgccatcagcagctcccaggttcttagaagagcttgcagctctgctaccggaaccattgcttgcagtatcttcgctgtcagctacatcttcacttgcgttatctgtagtttcagccttttcttttttcttgattttctttgctacaccgtttttgtcaaacttgtaaccagcatattctgtcttggttgcagcctgaccttttttgttgaaataatacttcttaccgtcaatcgtcttccaacccttggtcatgaagccgtaatctgtgtaatagtatttctctccgtccttcttcacccatccggtcgtaatcgtaccgtcatcgttgaagttgtactttttaccatcaatggttacaacgccggaagccagagaaccatcttttgtgaagtaaactttctttccgtttaccttggtccaaccggtaaccagtttaccatcttcgccgaagttgtaagttttgttatcgatcttctgtacaccagtaacagcaactccaaattcattgtagtatgtatcctttacttcgttccatcctgtcagcaatactccagatttctggaatgtgtattcatgaccatcgatgacctgttttccattcacacggtgaccttctgcatcaaagtagtaggtagaaccgttgatttctttccaggaacttgtaatcggatgaccctcgttgttcaggtagtagctgccagcctcatcaaatacccatgagcttgtttttacctggccttccattttgtagactctgtccgtgccacttccgtgccatccgtcagaattttgtgccgcatataccgtagttactgctgttccagctgtagccagacacaggactaaagcaactttctttgtgtttttttcgataaaattcatgttatcacctcgacatcaacgccctcattgtaacaaagcgtttttttatttgcaacccctattttttgaaaacttacgattttgtcacttttccgtcccatcacgattccctttaaaagctttgtttataggctgaaacccgattttagaaaattttaaaaaagttatgaaatttttttgtatttcttccgtttttcatccgaaatgcgtcagaaacacaaaaaggagccgtagccccttttttattgtttttttctttttacggtctgcggattgccgtgatactctgtccgctgttgttgctccagaagcttacagaggatgtgataactcctgtggatggattcgttgcatgaaccatctgtccgccgcctacgtaaatggatacgtgtgcaccaccgctccatacaatcagatcacctggctgcatattgccgtaggataccgctgaaccgacacttgcctgtccgcctgctgttctcgggatgctgatgcctgcctgtgcataggcataggaggtcagaccggagcagtcaaagcctgcaggtgaggatccgccccaaacgtaaggggagcctaccatggaagccgcaatgcctgccgcactggagttgcttccggaacctgccggattcagatttgcacttgaggaggaagagctgcttgaagccgccgcggagctgttgccagctgtgcgtgtgctctgtacattctcattgctttctgttgtttcttcttttttcttctctttgattttcttcgccacaccgttcttatcaaacttgtagcctgcatacttcgtgctggttgctgcctgtcccttgcggttgaaatagtatttctttccgtcaatggtcttccagccctttgtcataaagccatacttgtcgtaatagtatttttctccgtcttttttcacccagccactctgtaaggaaccgtcgctggagaagttataggtttttccgtcaatctctgtttttgctgttgccagagagccgtcttctttgaagtacagcttcttcccatctaccgtctgccatccgctgacaatgtttccgtccttatcgaacagatactgtttttcatcaattgtctgcagaccgttcagcttttcgccgaattcgctgtagtaggatgtttttgtctgattccagccggtcagcagtatgccggatttctggaactgatattcatgaccgtcaatgacctgttttccgttcacacggtgtccttcggagtcgaagtagtaaacagaaccgttgatggtcttccattcgctgataatcggatgcccgtctgcatccaggtagaagcttccgctttcgtcaaacagccatgagctggtcttgacagcgccttcctctttgtaaatgcggtccgctccggttccatgccatccgtccgcattagtggcagcatatacagttgtgactgcagttccagctgttgccaggcacagaatcagcgccacttttttggtatgtttttcaataaaattcatgttgtcacctcacagttttgcattctaacagagaaaattcctttttgcaaacccattttctgtaaaaagtgcaaaaagaatgcgcacagtgtaatgacacaacagcaaatccccgcttattcatgggcttttttactgttcggcaggatatataaaatttttttgattttttttatagcctactcttttttgaaccagtagacagagcctccggaatcttccgtaccagtgatgggattcactcgtttttcctgaatgccgtcactaggctgataccagacacccttacgttttttgtataacccgttaaaggtatccttgaagatgtccttgctgatggtgtaatactgcttttccagttcgcggttatcatcgaagccgctccagatgcctacggtatattccggattaaagcccataaccagtgaatcccagtcgctggtgcctgattttgccgccacggtgatatccggctcatgcccgtacatgcttgggaaggtataggatttattgcggatatcgaaggtcgaggtcatcatctgattcagtatcagtgtttcatcccgctggagcagccgtttcggctgaacctcacgcttgtatacaacatcattcccgctggtgatatgagaaatgagcgcaggcttaacatacagaccctcggaagcaaaggtattgtaaatacggctcagctccagcagcgacatattcacggtaccgagcgcctcacttggattcggagaggattgacggatgttgaaatcaagcagtgcgttgtgcagtgtatccacaccgagaaaaagctgtgtttttacggcgtagatattgtcactcagggaaatggcattgatcatggaaatttttccgttcgcatagacattgccgtaattggtcggcgcatactcctcatcatcggatacgcggaaggttgtcttctgtgaggtgaattgcgtggatggggtaaagccctgctggagggcgcagtaatacagcagcggcttgatggtactggcgacctgtcgggaggaatagatggcgcgattgtattgtgaaatcgtataatcctttcctccaaccatagccattacgtttccggtgaagggctgtgtgataatgccggctacctccagctcactgcttaaatccacatgcttcgtgacagcattgctcagctgcatttgtacctttgggtcataataggtgtgtacatgaatttcccggttcaaatcgatattcagcttgctgagctcctgaataaccgcatcgatgtagtattcatcaataccgtaggtactgatgtttacattggtggaaagcttcagcttttcctttttggctgcctcatactgctttgatgtaatgacaccgttattcttcaatacctccagaatcaaatgctcccgcttaattgcattgtccttgtgcagaaacggggaataaatactgggaccgtttggtattcctatcagcatggcagtttccgctatgctgagctgattcagctttttatcaaagaaatactctgcagcagcattcacaccatacacaccgtgtccgaaatagaccgtgttcagatagccctccagaatgtcctttttgctgtactgcatttccagacgggctgcataaaaaaattcctgcaccttcctcgataaggtctgttcatttgtcagaaacagattttttgcatattgctgtgtgatcgtggagccgccctgtcggatatccccatgaatgagattcgtacccagcgcctttgtaatgcgcacaggatcaaagccggcatggtagtagaaacgtttgtcctctacactcacaaacgcatcctgaacaaattcgggaatatcatcaatggacgtccactgcatattttttttgaaattggattcgtatatgatatcgccgttcacatcatagattgtaatgttctttctctgttcatccagcggtagtcgattgaacagggcgtaggcatagacacatacaatctgtgtgagcagtgcgaagatcattccaaacaccagcttgcggattcttttcatagcaacacctcgtatgctattagtgtgagcttttatgcgtgctttaaacacaaaatatgaaagtggtatacaccatccgcaaatattctataattataatatactatgattgatataataactcgttgatggaaggttagctgagatgaagataaatttttcctgtacgaaataaaattgccaactcctgctgaacagaaaatcatattttaaatagagtctattttatattataaaactataatatatcaattatactataactaatgcagaaatcgttagggggaatgataaagaactttaggagactgtttttgtgaattcacaccctatatattataaggaagagttttgtcactgccctatataatataaggaagagtttttttgaaaaatgaatcatcagaaccagagtgactatataatataaggaagagtttttttctgaatttatatgattggaagtaaaaggatagagaattgtcggaatggtttatagtattgtataaaagataatcccttgtacgcaatctgattctcaaagtggaatatgcttatatattctaaaagtataatattgttttgcattgattactattattccactattataataatatgcgcgatttgataaaaatgttctgtatgcatattttgtgcgtaaagtggcagttaaaattttaaagagaaaaagtgaaaaaaaggttgtacgatattcaatttctgctataatgctcatgataagtggtgacagcatgaaaaagcatatcgtagtaaaacagaaacatctttacacagaagagcgaaacctcatgtttgaaggacaggcttttttttcggattcaaacggctgtcttcggctttcctacacggaacgcggcagcaatactgcggtcagcgttgaagctgagaacgaggggcttcgcattcaacgggacggagaactcatgacacggctgacgtttcagcataaaaagcagacgacaggttctgttctgtcagaatttggaacgatcgatatcggagtttttacgcataaatatataaaaagagaaaatattatagccattgaatatgatattctaagcggtgacgaggtcacggacggatatcgtatcctttggattttaaaggaggataaggtgtgaatcagattgagaacaacttaaagcaggcattgcacaatgccgtgcagaaagcatttgatacagagcttgatacagcgagcattgtaattgaaataccaaaggacaaaagtcatggtgattactctacgaatgtggcaatgcaattgacccgggtattaaaaaataatccgcgtaaaatcgcagaggctgttgtagaggcactggataaagcggcggcagatatcgaaagctgtgaaattgcaggacccggctttatcaacttcacgatcaagaacacatcccttgcacagatcataacgagggttctgcaggagcaggacaactacggaaacagcaacgatggacaaggtctgaaggtgaatgtggaatatgtatctgcgaatccgacaggtgatttgcatctgggtcatgcaagaggtgcagcgtggggtgacagcatcacccgtttgatgaaagcaagcggatatgatgtgtgccgtgaatattatgttaatgatgccggaaatcagattgtaaatctaggcaagagtctgcaggcgagataccgtgagcatctgggtctggattttgatctgccggaggatggctatcacggggaagatgttaaaaacatcgcaattgcgattgcgggagaatataaggatgcctatgtcgaatacagcgatgccaacctgaaattctttaaggaaaaggggattgcattcgagcttgataaaatacggcgtgatctggataacttccgggtgcacttcgatgtatggagcagtgaacaaagcattcgtgatgaaggaaaggtcgaaaaggcactggaggtattgcatgaaaagggtcttacgtatgaagaagacggtgccctctggtttgcgacaacacgtttcggggacgataaggaccgtgttcttagaaaaaaggatggctcctacacatatctggtacctgatatagcatatcataaggataagttggatcgtggctatgatctgctcgtggatttgcttggtgccgatcatcacggatacattccacgtctgaaagcgagcattgaagcattgggaaataacccggacaagctgcaggtggatatcatccagatggtacgccttgttgaaaacggtgaagaggtcaagatgagcaagcgtcttggaaacgcggtaaccattcgtgaactctgtgaagaggtcggtgtggatgccgtacgctatttctttgtccagcgtgccgtggatacacacctggattttgatctggggcttgccagaaaacagagcaatgacaaccctgtatactatgcgcagtatgcacacgcccgtatctgttcgattttgcgacaggcttccgaaattgcggaggcgcagtcctttgagctgctgacgcatgaaaaggaaatcgcactgatgaagtatatcaatgaatttacgaatgtagtaagcgatgctgcacgttcccgtgcaccgcataaggtatgcaattatattcagaagctggcacagcatttccacagcttctataatgtatgcaaggtaatagatcctcagcagccggaactttcttcccagcgactggcactgctgaaagccacaaagatcacattgaagaatgccttatatctaatcggcgttgacgccattgaaaaaatgtaggaggagcatgaagttattatgaaaaagtctatggtcgatgtagcatatgatttgatgtctacgaagaagaaagctattgtattcctgaagctgtgggaagaagtctgccaggttatggcatttacgaagcagcaggaggaagacaatatcgcacagttttacagtgatctgtcgctggatgaccgatttgtaaatgtcggagaaaacaaatgggacctcagagaacgccacacctatcatgaagttgttgtggatacggaagaaatccttatcgatgaggaggctgacgatgactacgaggaagacgatgctgcaaaagcaggggatgaagaattctaaaaaggatgcatcccctttttcatgcctctaagccgttatccgcatgtactatggaagcatagcagcatactgcttttggaaaatcagggaaggaaggccgtcaacctacggatgcctgccatggctgccgtgatataaaaggttttccgtaagcaaacttgaaatatgcccttttttgaaaatatgtgtccaaaagcttttcaaaaggggaaaaatgcagtagaataatagtgttaagagactaaaggaggaatttgattatggcattagtatccgcaacagaaatgctgaataaagcacacgaaggtcattacgcagttggtgctttcaacattaacaaccttgaatggacaaagatgattttactggcagctgaagaagctaaatctccggttatgttaggagtatctgaaggtgctgctaaatacatgtgtggatttaagactgtagtagctatggttaaagaagttcacgacagcttgggaatcactgtaccggttgctctgcatctggatcacggaagctacgaaggtgcaaaagcctgtatcgaagctggattcacatctgtaatgttcgacggttcacactatgcattcgaagaaaacctggcaaaatccaaggaaatgattgaactggctcattctaaaggattatccatcgaatgtgaagttggtggaatcggtggtgaagaagatggtgttgcttccatgggtgagcttgctgatcctcaggaatgtaagacaatcgctgagctgggagtagacttcctggctgccggaatcggtaatatccacggaaaataccctgctgactgggctggtctgaactttgaacgtctgggagaaatccaggatgtaacaaacggaaaaccactggtactgcatggtggatcaggaattcctgctgatcagattgctaaggctatctctttaggtgtttccaagatcaacgttaacactgagctgcagctggtattcgcagatgctactcgtaaatatgtggaagctggaaaagacctggaaggtaagggctacgaccctcgtaaactgctgaagccaggatgcgatgcaatcaaagataaagttacatctatgatgaaagaattcggttcttacggtaaagctgaataatcaaacaaaacgaaacggcagatatctgccgtttttcaaaactgaggctgatgggcggtaaaagctgtcatttcggcaaggtatatggggtatgctgcaaaaaacatgctccttttttttctctgctgcgtttgattttcccgggaaatagcgatttcttttcaaactatataaggatagaatctataattgtacagattgtgtcgaaagatgtgaaaagatttggatttgattttgaaagctatgcttgttattttataaatagaaacattcgattctgatatcgtaggagtgatggtatgaataaaattatgcttctcgtctttctgacgattattatgatagcggtagccgttccctttgttattcgcagctttttatggaacagagtattgaaactgcttcataacgggcagtacgataaggttctcatcatgctgaacagcaaagcgtttcagctgttttttaaggagtatgaccgtaactggaacacgctgcgtgtttacctggcacagggaaataaccgtaaaattgaagaacagaccaaaaagctgcttgacagccgactaacaaatgcgcaggcatatcagatagccagtcaaacctatttttatttccttgaccgggaaaaccgagatgtatgtgaacggttgctctcctatattgagaaaagcgcaggggaggaagaacttttatatgatcgaatgctgtttcgcatcatgattgaaaaaaagagtgaagatatcgcagaaatggaagcactccttgagaaaaaggaagcagaaaaaataaaaaaagatcaaaagcaggatcagcaggtacagatgggtattctacaatatctgcttggactacagtattcctaccagaaaaaccgccgacagatggagctgtatctgaacaaagccagagtgaatctgaagggtacgccataccataaaaaagtcaaacagctattgaataaagcatgatttcgtttaagacgcgggaggaattgcatgaatattatgttgaatcttgacaaacgctgtcaggaaatcttaaaaaggctaatgtatgccggaggatatctgaaaatacaggatcttgcggatgaaatgcagatatcaagacgcagtgtgtattatgatatcactaaaatcaatgaatggctggaggatcaggaaatcgatccgcttgttcaggaacgcggcaagggtatttttgtcagcagtgagcagtccagaaggatacaggaggcaatgagtgatcaggggagtgataactatcatgtctttaccccggatgagcgaaatcggattgagatatgtgcaatcattatccgttcccatccgctgtatatagagaatttcatggaggtatgtcaggtcagcagaaatacggtgatcaatgatctgaaaaatgtcatacgattccttgaaaattacaatctggagctgacctacgatatcaaaagcggctatcgtattgctggagacacgattaagaagcgtgcaattttctttatgctgtttccatccttatgggagtattatgaccggcaggttgtccttgtggaaaatgagcagtatatccgtgaaattctggtaaagctgaagaaaattgaaagtgagctgcatgcggaatatgtcagcggagtactgccgacacttgctgttttcatgtctgctattgacaagcgcagtgatcagctgacgttctcggatatggatgaggaggagattgtagaaacaaaggaatatcagcttgtttcacagtattttccggatttggaaaatggtgagaaaatttatgtaactctgcatctgctggggtcgagactgcagacgattcctgtcaatgtcatgaaggagcaggatgaaacctacgagatttccaaaaaccttgttcatgaatttgaacgcctgacctgtatattctttgatcaggaggaggagctggtggatgcgatcaatgcgcatctgaaaacatccctgtatcgctatcgatacggtattcagctgggaaatccgatgctgaacagcatcaagacggagtatgaggagctttacgaaattacaaaaaaatcctgtgaatatctggaaaaaaagctgggctgtctgatatccgatgcagaggtagcctacattacactgcattttggtgcatttctgacgaccaatcagacacagaagcgcaatctgcgtatcctgatcatctgtccaaacggaatcggaacaggaaatatgctgcgtaatgaggtggcttcacttgtgccgcaggcaactgaaatcgtgaaccttccgttgagtcagtacgaggaaaatcatgattttgatgttgtgatatccaccgtcgtccttccgaaggaaaagaagctgattgtcgtacatccgattctgacagatcaggacagggttaccatactgcgtaactgcatgtataccgaaccgcaggccaatctgcagatacaggagattgtgcgactggcaaccagttatattccatcctccaagctggatgagtttgaaaaagatttgcaggattactattccagcatacagattcgtacggtgccccaccgaaatttcggtcagaatctcgtatattatctcaagccctcccatattcagatttgccgggaggattgtgactgggaagaggctctgcgtctgtcctgccgtccgcttctgatggaggactccattacacaggagtatgtggaggcaatcgtggaggatcagagaaaccgcggtctgatgatgtttctagcagacggactcgtgcttgcgcatgcagcgattgaaaagggtgtgaagcagcttgatgtggccttatgcacgtttaagcatccggttacctttctgaatggaaagcaggcacgcatcatcatcgtattatgtgcggaggatcagaccaagcatatccgcatcctgaatgatgtgctgaatatattttcaaaaaagaagagtattgagcagctggcagcattggaaagcagtgaggatattcagagctatattcgcgcgcatacacaggaaaatgaaggttaatttgcacttaagcgattacaaattgcacaatatctaacattttgcacaaaaacgggaaaacaattggtcttgtatttccaaccgaaaaaaaagataatgaaaacgtaaagaggtaaggttatgacatctatggaaaaactgttacaggaaaaaaactgttacctgagagatcgggtgcaggactggaaagaagctgttcacattgcatgtgaaccattgatcgagcagaattactgcacaacggcatatgaagctgccatttacgaaatcacagaaaggcttggtccatactatgtactctgtgagaacctggccctgattcacgccagcaaccaatccggtgtcaatgacacacagatggctgtgaccgtgctcaaggagccggtgaaattcaagccggacggatatgatgtccgtgtactggtaacactggttgccaaagacagtgaatcccacatggaagggattcaggctgtatccaacatcttctccgatgagaagaaggttcaggaaattctggacgcaacatgcccgaaggaaatattcgacctgtttgtttccaacgcatgtgaaaaatagcgttaaccatttgaaagggaggatttacacatatgttagaatttattatcaacatactgtccacacctgcaattcttgtaggtctgatgtctttgctgggtcttgcgcttcagcgtaagccaatcgaagatattgtcaagggaaccgttaaaacaatcgtcggcttcctcgtattatctgccggagcttcgttcctgcagtccggatcattgaatgcgttcggtgatttgttcaattatgcatttagtatgcagggggttgttccaaacaatgaagcaattgtttctctggctctgaaggacttcgctacagatactgcttatatcatgtgtctgggtatggtcttcaatatcattatggctcgtttctcaagaatgcactacattttcttaacaggtcatcatactctttacatggcatgtatgcttgccgttattctgaatgtcggtggtcttaccagctggcagctgtggctgggcggcggacttctgcttggcttcatcatggcattctctcctgcgttctgtcagccgacaatgcgcaagattaccaaaacggatgagcttggcttcggtcacttcggtggtgccggatactggtttgctgcacagtgtgggaagctgttcaagggcaaaggaaaatcaacagaggaagttaacttccctcagcgtctgaccttcctgcgtgatacaaccgtagcaatcggtcttaccatggtgatcttcttcctgatcgttacaaccgtagcggtaagcaagggtatcctgagtgcagatgctgcagctattcttgaaaaatatccaaaccttgctggtctgctgaacgttggggctgaaacaaagactcactgggctgtatgggcaattacaagcggtctgagcttcgctggtggtgtttacatcatcctgagcggtgttcgtctgattgtcggggaaatcgttcctgcattccgtggtattgctgagaagctggttccaggtgctgtacctgcaatcgactgtccagtcgtattcccttatgctccaaatgctgtactgatcggattcctggtatccttccttggaggtatcgtgggactgttcattcttggattcatcgatacaaaccttatgagtgttgcactgattctgcctggtgttattcctcacttcttctgtggagcaacagctggtgtattcggtaacgctgagggtggattaaaaggctgtgtattcggaagcttcatgcacggattactgattaccttcctgcctgctatctgtatgccggttatgggttccctgaacttcgctaactgtacattctctgatgcagacttctcctggatgggaatcgtcttcggaaatatcgctcaggttgttcagggcgtaggtctgttaggtgtctgtgcagttgtattcctgattcctatcgtgtacaattatgttgcacctaagaaagcaaaaaaagctgaataagctttggaaagaaggaaaataagttatggaaatcagaagcattatgtgttgctgcggacagggacttggaagcagcatgatcgtcagcatgaacgtcgaaaaagctctgaagaagctgggcgtatccggtgtaaaggttgagcatacggcaatcggtgaagtaacagaaggaagtgctgacctgtttgtcatcggagcagaccttgcacctcagatgacgagctacaaaaacaagatcatcttaaatcagcttatggatatgaatgaaatcgaaaccaagctgaaagaagtattcggtctttaaaaaaacggaaaaagaaggctgtttcttccatccttctttttctttacaaatttttgataaaaaacagcagaaataagcgtgaaaactggagcatcgctaattgtacagcgaacgtaaaaagagctgtaccatacattgcctgaaggcttgcacgctatctgaaaaggaggtaatagcattggaaacatcacaactgaaggaattgcaggtatttgctgcacaactgcgaatggatatactggaaatgctggaacacagaggatacggacatttgggaggttctctatccatcgttgaactgatgagtgttctgtatggtaaacagctgcatgtggatccgaaaaacccgaagatggaggatcgcgatatggtcgttttatcaaagggtcatgcgggacctgcctggtactgtgcgctggcagagaagggctttttcgacaaggaatggctgatgacactgaatgatggtggtacaagacttccaagtcatcccgaccgtacaaaaactccgggtgttgacatgacaaccggatctctgggacagggtacaagtgctgctgcaggtattgcgacggggctgcgtatgaaaggatcaagtcgttatgtctacatgattgtgggagatggcgagttgaatgaagggcagtgctgggaagccttccagtatgttgctcattataagctgaataactgtatcgtgattattgacgataacaagcggcagcttgacgggtatacgaaggatgtcatgaatcctttcagtattcctgataagatgaaggcattcggctttgatgttcaggtcgtaaagggaaatgacattgaagcgattgatgcggcaattgaacaggccaaagcggtaaaggatcaggcagtatgtatcgttctggatacgatcaaaggacagggtgtaccgtactttgaagaaatggtatccaatcattctgtcaaattcaacagtgatgaagttatcaatgaaacacataaggcgattgcagatttaaagcaatttattgaaaaggagggacagtagaatgtttactctcagcaaagaccgcagtaaaaaagggaaagagctgcgtatggttgtcgtggaaacactgcaggatatgatgaagagcgatgctcaggttgtggcaatggaagctgaccttggcggtgcaagcggctttaccaagattcagaaaagcaatccggaccggttcattcagtgcggtatttcagaagcaaacatgacaggtgttgcggcagggctgtctgtgacaggcttcaaaccgtatttacatacgtttggaccctttgcttccagaagaatctacgatcagattttcctgtctggtgcatatgccggtaatacaatgaacatatacggttcggatcccggatttacggcagggccaaacgggggaacacatactacatgggaggatgtcgctctgatgcgcgcaattccgcatgctgtggtatgcgatgcagccgatgaggtacagctggactggatcataagagaattcgcaaggatggagggtgtgcattatatccgtgcaaatcgtaaggatgtacgcaatgtatacgaaaaaggctccacctttgaaatgggaaaaggaaatattgtaagagaaggaagcgatgttttgattatatctgccggacagctggtgagcgatgcactggattgtgcggaagtattgtcaaaacaaggaatttccgtggaagtcatcgatatgttctgcatcaagccgctggatgaggagctgatcattcgtgaggcagcagggaaaaaggctgttgtaacatttgaaaatcactcgattatcggtggtctgggaagtgctgtcgcagaggttcttgcggagaacaatatctctgtgaagttcaaacgacatggtgttaaagaacgcttcggcgcagtaggtactccggaattcttgcagaaggaattccgattaactgcagaggatttgcttcagacagtggaaaacacattgaaataatacaaagagggatcagtctgaatctgattcctttttgtatgcatatccgtcttcgacaacatgtattatatcagtgaatcaacacataaaatgctatgcaatagatataccggaaattccagaaactatgaggcttctgcgtctgtccttcttcattctcatacatggttctgcgatttttatgtgttctttatcacatgaacgaagtaaaaacttaaaaaagagaagatgttatatcatgttatctttatttttataacatgttgtgttatattttaaggggaactacattcaggaaaggggatgaaacaatgcagaaaaaagaaggtgctccgctgtatctgcagatttacaaggagttgcagaaacgaatagaaaatggagtatataaagaaaatgagcttctgccatcagaagcatccttacaagcggaattcaatgtcagccgtataacgattagacgttcacttcaggatttggagcttgccggatttataaaagtgcaaaaggggaaaggtgctatggtgctggcgaatagaaaatataccgatttggtcggtgtcagcagtttctcacaggatgctatgaagtccggggaacggccttcttctattatcttggaatttgaagaattgaaagcttccggtatcgtatgtgattacttacagcttcaggagggcgctgatatttaccgcctgaaacgtctgcgcttgaaaaatggaagaatcatcgggatgaatgaacagtttatatcgaggcaaaccggttttgaactacacgcagatgtattgaatgaaaaaacatcaatctatgccttatatgaagaacagggtctccatatagagcgtgcagtagaatccatagaggcggtaatgccatctacggcattgcggaaagagctttatatgaatgaaggagagccgttatttaggagagagcgaatcacttatgattacaagaacaggccgctggaattatcgataaattcctataaagcggatgaatacaaatatatcattacattgaaaaaggatgagctataagcagcttattgatctgttgcagtaggctttcactctgtggcttcacgagtctgtctgcatgcttatgatatcccgttgaggaaaatgaatatgtcatatttttgatgaaagcagtgaacggttgtttgctgctctttttgatttacagcaaagtaatgcataccgtattgcttcataagtaaatagaatgaaaaagggcatataatccagtccgccattacttttttgtttcgatgatataacaagtgaacagctattataccgcatgtttttatgtaaaaggcttacatagataacaaaatttgtaattcatacagttaatattgacaaacatgatataataagttattatatggctataacatgttatatcatgattagaacaggagggagacgacttgaagtattatgatattcactcccatttagggaagacaagctccggagatgaaaacacacccagcgagctggtaacagatttgaagaggtatggtattgaaaaggtcggtatcagctgtctttcagggatatctacaagagagcagaatgatttgatttaccgtgcaatgcaggaatatccagaggtcattgagggctatgcgtttatcaatccaaaggatgcagctgcagaaaatgaaatagacctatgccttgggacatatggcatgagtgcagtgaagtttcattcctggaagcatggctattatccggataattccggatccctcgatcgcctgctggacaaaatcgattcctatggtgtgcatgtgcaaacccatgtcggtactgcaccaatcagcaatccctatgtctgggcagaatatgccaaaaagcatccgcatgtccgttttgtattcactcacatcgggtattatgaattcgggatgtccacgatagaagcggttaaggatttaccgaatgtctgggtggaaacctccggacaaatggatgtagaggtattaaaaaaagcgatagctgtgctgggatcgaaacgtgtctgctttggtacggactggccctataagccggtaaatatggagatcagcaaattttatgagttggaattaacagaagagcagcgcgctgatattttttatcggaatgctgaaaaattatggaagcgagtaagggaggaacagatatgaacataactacgtttcgaattgatgatcgactgattcacggacaggtggtaaccgcctggatagcacatagtgatgcaaagcagattttggttgcggatgatgcggctgcgaaggataccctgcagcagtccctcctcaaaatggcaacaccgaaaaaggttgatttaaaaattatgagtcttgaggatgcaaagcagctgattcaaaacgacgagagtgatacaaaaacactgctgcttgtacgcggtccgaagcaggcgttgtatttgattgacagctgcagcgatgtaaaaagtataaatgtcggaaatatcaatatgaaaaaggggaaaagaaaaattctggggaactgctggctgaatgatgaggaagaaaaggatattcgtcttcttgcagaaaaggtggaggttgaagtacgcgctgtaccaaatgagcataaacagattctggtaaatctgctttaatttagaaaggaagggaattttatgagtttatttttacaggcatttcttgtcgcgctggctgtgacaattgcatttattgatgcacatacaacacagacacacatcttccgcccaatatttattggaccattggttggtgctatcatgggggatttcaataccggattgcaggtaggtgtaaccgttgagcttatgtttcttgctgttatctttgttggaacagcagtgccccccaatcccacgatttcaacagcaatcgcaactgctgtagccattttgggtggcggagggacagatctggcagtagcaactgcacttcctgtatccttcataggtcagattgcggagacggtgcaaaattccgtaatcaatgtatggtttatgcatagagcggagcatgcgattgaaaaactggatacaagagggctggttatgaacaatatcgtctttacaatggcgatgaatgcccttctctatggagtaccaacctttcttgctgtatattttggtgccgattttgtagcagatatcattaaagcgattccggataagattataaccggattatctgtaggaggaaatatggtaggtgctgtcggttttgctttactgctcagctctatcaaaaatcataccatgtggccgttcctgtttctcggatttttctttgcggcctatctgcagatcaatatggtaggtattgcactgctggctgttgtttttgcggcactgtattactatttcaaacttgcagatgagggaaaggagtaggcaaatggaagcaaagaaactaacaaaaaaagatttatggaaggtattccgcggtcagcttacaatccgtggagcaaataactatgagcgccagcaaaatgccggctttactcaggctatgatgccggtcattgaaaaggtctatgacaatgatgaggataagcgggaggcttatgaacggcatatggaatattttctgacaaatgatatcacaagtgcaattcctgtcggaattgctgcggcaatggaagaaatgcacgcaaatgatccggatatggatcccaatgcaatcaatgcggtaaaaactgcccttatgggacctcttgcaggccttggggattccttgctgaatggtacagcaagacctattctggcaagtcttgccatttctcttgtacatgccaatctgggatgggtaggaccgatattctttgttatcggtatgagtatcgtttccctgggcatccgctatctgggagtatttcagggatataagcagggaatcaagcttgttgaaaaaattaactccagtggtctgatttccaaaattacagatattgccgcaatcgctgcctatacgattgtcggaggcttcataccggctctggttgttatgaacattccgattgaaataaagtccggtgagacagttatcaatattcagaagacattggatggtctgatgccgggtgttctgggtctggcctataccttcctgatgtattatctggtaacaaagaaaaaaatctcggcagttaaactgattttcttcacaatggtgtttgctatacttgcagtttatgcaggcattcttggctaaggaggtgctctgatgatagatattcattcgcatttaaaaacagacagtgaagaaggcagtatgcaaaagctcttgcaggatatggaccgtttccatatcaatcggcgtgttatttcagatatgcgctatgatgatgtgcaagatggaaaccagaaaattgctgagctggtaaaggaataccctgagcgtttgatcggatgtgcagtgctgaatcctgcactatctacgattctcgaggatacaagacatgcctgctcgctgaaagaaatccgtatgatagaattcgattcatatcgtcatggctatgctcccgatgattgtcctgttctggatgatgtgttcgcaatgctgcaggagcgcggtttgccagttaaggtattttccggtattggcgcaaaggccttgccgcatcagtgggaatcgtatacaagaagatatccgcaaataccgtttatctatttgcatatgggatgctttgattacgggtacagctgcgtggatattgtaaagcggaataaaaatgcatatgtagaaacgagtaatcagtatgaaatgcagattctgaaaaaggcattccggcagcttcgtgaagaacagatcgtattcggaacaacctatccgcagcgttttacaaaaaatgctgtggaggtatttgatttatttgatttgaaagaggatcagctgcagatgtttacggatggaaatggcaaacgtctgctgcagatgtgaggaaaaagaatgtatacagtaaatttagaaaaggcgaggaaagctcttccggctgctgctgtgaaggactttgatgacattgttgagcaaagagtattaggggctagcaagcatattcaaatgattgggaaaatgattgagcaaattgctgttgacagtgttgaaacgaatcgtacgatagcggaaatgctggagcgaatccaggaggtctgtcagttttttattcataccagaggagaggcatcgcaggcgataacgaatgctgtctatctgatgactgccggatacagacagcatgaggaacgtgatattcgtacctatgcacagcgtattatagatgtgaaaaagcaatatgagcgggattgtacggccgcatcagaaaccgctgtttcctatgctgtggaaatagggaatcgtatgtctgcaatcatggtatatgattattccagcagtgtggaagcattcctgcgtaaaatcaacggtcccaagcgtatttatataccggaaagccgtgtgatcaatggcggtgctcccttcgttcagccatgtcttgaagcaggacatcagattcatttcattcctgatgcgagcatgatgtattatatgaaatcctgtgatggtgtttttatgggggcagagagcatatacccggatggtacgggcttcaatacaaccggatctgatattgtcggtctgctttgtgattattttcatgtgccgctgtattttatatcccctttgatcaagctggatgtacgtcctgtgtatggaaaagagaaatgtacggtgataaacgatttgcgaagcaagctggagcctgtggcaaatccgaagcaggtgaagggaaccattgattatacagcaccggagctgcttgcggtgtcaccggggtttatcaaggcgttcatcacggagcagggagtaattccggctacgcaactgtatgatataagcatgaagtatataaaagaactgagaggtgcagatgatgtttaaacctgattgtacggcatttgccatgatccagcccagtgcgctgcctggaagctaccggcatgaggataaaacgattgatgatatcgttgcagaggttttggaagaaacacaaatgattgtggataatggctttgacggcgtaattttacaaaatatgaacgatatgccaatcaagcaaaatgcagctccggaggcaatcgcctatatgacgcgtatcgcatatgaaataaagcatcagtatccgcagcttatccttggtgttcttgtgaattgggatggcgttgccagccttgccgtggcggatgccgtacatgccgattttgtgcgtgtggagcatctgtttacaggcgcaaatgttacaagtgcaggtatattggaggggcagtgtgttgaaatcgcagccttgcgtaagagaatacgctccaaggttcccgtatatgcggatatacaggaggttcatggaatcccgttaggtggtaagccgattgatgatgcagcatgggaagcagtgcatgaggcttttgcggatggattatttgtatccggcaaaagcaaggaggaaagccttgaaatgatacatgctgtacgtaaaaagcttccggatacaccggtaattttaggtggaggcgccaatggcgaaaacattgaagagctattgcaatactatgatggtgtatcggtcgcaacatgggtgaaaaatggaaatatgaaaaatccaattgatccaaaacgtgcagagattttcatgagcagtgtacagaaggccagagaaaagaaacgggggagatcgtaatgacagggcttatcatctgcggtcatggcgactttgcagcagggatgtacagctccttgaagctgttaaatggggagtgtgagcatcttgtctgcataagctttcaggagggaacctcctttgaagatctgtgcgacacggtgaataaggaagtggaaaggtttatcgacggaaatgtcattatcctcactgacttgccgggcggctctccttttaaagctgccgcaatggctacctttcagtatggctatgccagagcggtaaccggcacgaacttccctcttttgctggatttggttttatcaagggattatgcagaggatgtggatcagctgcttgatcaaagcattgataacgcaagggaagcgttaatgaaaatgtcattggagcagtaaatgaaaataagaagagaaagaccttttatgaggttccttctcttcttttgctatttgtgaagaacgtttcatcctgccattcaatctttaatcctccgttatctaatatctgaatcggaagcatgctgtaggcagaggagcgcaaatcatccgggtgccagtgatccagcagtacatagggctgattctgcacaaagaaaatacaggtcccctgtccgtcaaaggtggtacgatatgcaggaccggtgcaaggattatcgatcagcttccatggtcctatcagatggtcacagatgccatataaggagggattgggttcccatccgctgcatccggaagtaatcatgtagtagcggttatgggaatacatgatggccggtgcctcccgctcctgatcctggaaaatactgatataggaaccggtaacatccagataatcatcacttaatcgtgcaatattcattgttttattgtaatttgcactgtgaatcagccaggcactgccgtccagatcctgaaacagcgtcatatccctgctgtcctgccggttgggctgaaagctctttagccagacaaatggtccggttggagaagctgcgaccgcaacattaacaccggcatagtaataatctgcagtatccgcatgggtatacattacaaactgcttggtgcttttattatataatactctggggcgttcacatatgtttttggtatacagcatgtgtgcagggttgttcactaccggtgaaagtacaataccttcattcctccagttttccaagtcttcagaggagtaacaggaaataccaataaaatcgacgtgacgattaactgtttccgtatccttgttctctccataccagtaatatattcctttatgctgcagtatcattccgccatgtgcctgtataggctttccttcggtatccgtccataatgttttgtttttcattgttaagctcctttttcatgttcagtctgtaagcatagcaatattataagggatgcgtctataacatacaatggatatcaatatagagatatgcttttggtgtatcaaaacgaaattttgtaatttcaacctgctttggtatctttatttttaagcttcctgaattgattaaatgtgaatccatacgctgattttgtttgtctaggcgaagatcacaaagctagattctagtgaacgaagtatgagccgaatggaaaatactatttactttttcaaaaagacagatagacttttatacaacggagtaaaacgtaaaattatataagacaacagaacaccgctgaaattcaggataaaatcatcaatatccatagtaccgctcagtgtaaaaaactgcagaatctctaccatgatgatgataaatgccatacggagcagcagcttcacaggacgcttcgcccagtcagtaagtaaaagcaggaaaaaggaaaacggcataaaggcgacaaaattacccagcagattcataacggcaatccggttgtccacatacggcatatcgaaaatcgccatcatctgatgaatggttgcgaacggcttcagactggttccatattcccattgcatccgcagggaatccggataggactgcgagcgcaggtctacataatctcgtgcgaactcactggcaaaaaagaggatatagatcatttgaaatatatagaaggaaaacaggacgatccacatgagacgcagatttcttgtttgcttttgtgtatcatagagacggttctgcaggcagacaccaaggatcagtgtcgagcatatgaggacagaaaacataacgattcctgagaagttcagataattttctattgtgagataaaaataaagcagcattgccgttatggatatgcctaggcatacataggacagctcttttttatatttcatggacatgcaaaaactcccttcatgtgtatatatgatataggagaacggatatttccacaagaggagaagccttaatattttcttatgtttgtcgaaagaaataagataagcgaagaaagcggcagcagaacttctcatcctgtcgtttttttggaaaagctgttggacatggaagaaaaacttcaacggattcttctactaaatcacagggcgataccatatactgtaacggatatccccgtgtaaaatataggatgaaaaagcatggtacagacaactgtacgggaatctttaactttttcttaagacgggaaataccatatacaaatgcggattctgtagtataatatccttgtgaggttaaacaaggatgaagatatttacatgtgaaaaatgcggtacttctatcaaactgcattttataaagggctatgtgcatctgcgctgtcctgcctgcggggcagagtatcagcttgatactggaagcctgaaaaaatatatgctcatacccctgctgtccgttgcggcggcggttggtaccagcttgcgatttctgcagggaagaacaattgatatcaaatgtatctatatactgacagtgtcttttatgctgtcggggctgctgggcacgctttgtgtcaagacaggactgttaacgtatgaagagaaggaaaacaggtgaaggcatgaaaaaaatgaggaaaacaccagaaaaacaatatcagctggctgtggacggcattcgtccgctgaatgtacaggacagtaaggatcggctgcttgcattctgtatggatgtcagcatcatgctgtgtccgattgctttatggaatattattctgcttgccgtgctgggaaatatcatcagcatctccggcattaagctgatcagcatctttatcggggggctgcttgttatctctattttatttctgaacagctatatctaccggcaaaccggcggacagagtgtcggcatgcgtatgttcggctttaaggtggtcaagaaaagcgggcgcaaagccagcagacagcagcttcttttacgggagcttgtaggcttcgatcttccgtttatcatcctgatgtattttacaaatgcattcggtgttgttgcatactgggggttgaacggtttgtttacgcttgcggacagccgtcatcgctctttgatcgatcttgttcttggaacacgggttgttgcattagagaaagcacaacagcctgtacaaaaagaaaaagctccgcaggcggtaaagcagccgctgccgaaacaggctgagcagccggaattgattatgaatacgatggatctgcatattcattccaatttctccgatcgcgggcagtataatgtcgaagagattttccaatatgcgaagcgcaaccacattcggacggtttccataaccgatctggactgtgcaaaggcaaacagtattgcggtgagaatgagtgagctgtatggtgtaacctatattccgggtattgaaatcaactgtgatctgcgtggaagacgtgtgcgtattctcggttatttcattcagtataacagtgaattattcgcacatattgaaaatgaaagtctggtgaatgagaagagggccagcattgaccgtgtccgcagatttgaggcattgctgggacgtaatattgatgaggaacggcttctgaaaagcaaccggttccagcgtttgagcggtgaactgattgccaagcatgtactgaatcgaccggaatttgatgattgtgccattttaaagccgtatcgcagagatgaattcggatggcgagctttgaataaagattacttcgcatacggaaagccatgctatgtacctgtgaagtatccatatcttaaggatgtactggatgtcattgaactgacgggcggtatctctgtgcttgcccatccaggaaagctgctggtacaggagccggagctactggacgaggctttgctcatgggtgtacagggaattgaagtcttccatccaatgcatacaaagaaggaaatggcaagtctgttaaagcttgcgacagaccgtaagctgctcgtcagtgcgggaagcggcttctataatatggaaggaaacacacgcatcggaagatgcaactgtccaaaggaggcagaaggcttaatcgatatgatgctgcatgcacgtatgtaagaagataagaacagacaaattcatcctctatgaatctgtctgttcttgtaactattaaaagtcgtttatctacaggactccttccaattagtgacttaaacttatacgagaagagtcattacaatcattacgtaatacttttatttattatgtctctttatccctatgaacccttaaaagttaaatattaatgttttatatatagctgctgtagtcagtattaggggtgtttataatgaattattttttttaatataagttaccttattccactctttctggcgaagtccaatgtaaaaatagtttaatgaataagaagctactatcacctgtaagtaacacgattttaaaagatagttaaaaggccatataaatattcaatgcataaatgaagaataatcatgaatataaatattatgatactgtctacttttttgtcattagtcgtctttattttgagtaatagcaagtaaataaataacaaccctgctttatctatcataataaagcctatatagatatgatgagaaaatagataacaagaaataagttgtattactgctaaaaatatatcacttatcaaactttttttaataattaaatcacgaagcaaattaggttttcgaatttctatttcatactttaaattcataaagtcaaatgtagtatcaaaaagatatagtatttcaaataacaagaagagacaagtaagacatatcattaaaatgttcgtaggcataccgtaaactacctgattgaaaaatattttattgtagtttaataataaataggagataggaaaaagcaaactgtaagctaatagatatttgtgctttctaatcaatacattcatataattgttccttatctatagtaaatttcctattgaaagggatttcgtcaactccatcatgagcacatataataatagttttcttatcagaatttaatttctttacaagttcaataaatttattgcttgatgtattatcgagacctcttgtaggctcatcaaataagataatattctgattttccataatagcttgaataataccaagtttttgacgcatacctactgaatatttttttactgcccttttatcttctaaagttaaatcaaaatattccatatagctttgaacagtttttctatcgtaactgtttttcagatcatataagaatttcaaattatattcagcactctcgttctcaataaacgcaggattttcaattaaagcacctatttcaatatcattattttcgattattacttcacctttatctgcatttaaaagaccagcaattatctttaaaagagtagattttcctgaaccatttgatccggtgatatgaatcaaatcacctctgtgaatatccatatttacattacgtagaatgctaacattatgaaaagcgatagaaatatttacaagttgtatcatttgattgtctccttcacaatttttcgagtataggcagcatgattaagtaatgaaacacaaacattaataaaaatggtgccattaataatattttagttattcttttgccaacaaaaagagcggcagtatttaaacaactaatcataaggtataggatactgatgttaatcaaatatagcatatatatctttggcatatatgcaagttgattataaaatggaagtatataagttatgatgataaaaataagagaattaagaaactctatgcataagatttgagttacaagtttgttttctttgatccttaagaatatgtgatatttcatagcatataaacaattagccctccaatagttaaaggaaaaaaatatcgaacacgtaactaaaggcaagtagttattccctatgtatgatataaagccaatcttcgaatcgctttcatatagaaataggaaaaaaatcaaaatagaaagaatatataataggatatatttactcttaagagatactatgtaatttctcagcataagtattttctccatctctttaaaagcacatacaatatagaaataaagaatatataaaatatgaaggcagaaagataatttaaataccctatttgaagcaatgacattccaggacaaatcaaacttgtaggtaaaattgcatttgtcaataaccgtaagggtaaaggtattgatttatattgaaaaataattacacttaatcttattactaaattcactaaaactacactacctatcattatcaataatggataaaggtgaaagaaatatcgccttttaataaagaaaatggatacatatacaaaaatgataaagagagtgaagcctaggcaactgaatagtgagaacaagagataattgataatgggatttttaaaaaataataaataatcatcaggaataaaatgaatagacaatgagggatgataaacaaaatatatacctaaaagaatgaaacaatgtaataaagatatggaaagaaaagattctgctagaagttttttcaaattacggatgtgaaatttttttataccgattcgtaatattgcgatgttttctgcgccattttcatgtagtgcgaatatattatatagcagaatgttaggaagaataagcaatagtaacagaataaatataagatttaaattaaaatcccagatacgaataccaacagagaataaattccattcatttgcatattggaaaaaatcctttgcataaaaaacagcataggagctgagagtaattaatgcagtaaataagattattaagtgttttttttgtttcataatggcccccttttataacaaaaaccgaaagacttcggttttctattatgtattcatttaatttgtcggtgtaaaattaatggaaacttgacctccaaaatttacattagaagaggaaactcttgcgccaatccaccaatccttggacttgtatccgtttaaataataaattcttttatcataaccttccgctaaagaataatatgaattggaacggcgttccccatggaaataaaagtctccatatgtcgtccaacctgtattattagaatatagatgaatataaccatagtcacaagctttgtttttcttagtagatgttttcgttctttcactccaagcaccccaagctgggacatttagcgtttcttttgaagaccattgagtagcagatattgagagagttgtcgttaaagcaacaactaaggtgaaaaagcatacaaaaatttttttcatagtaccaccctttctttagttaattataacatgttatcaccttgtttacaagctcgtatcatattgtttacccccaaatataaaagaaaagtgttttatggagaaaagaggctggaaattggagttatattaagataattatgtgattggaagggggaaaaataataacagcagaagtatgtccagatcatgtacatatgctagtggaaataccgccgaaaatgacagtatcaggattcatgggatttctgaaggggaaaagcagtattatgatatatcagaaatggagaagcatgaaatacaattatagaaacagatcattcttgtgtagaggaatacagtaggaaaaatgacaaagtaatcaaagcatgtatagagcagcgactgaaagaagatgaattgagtgaacaatagattctccatatagaggactcgtttacaggtaatcgtaaatagaaatgcaaatacgtattgttatgctggaaagcgtagcttgaatttgagctccttggggcgattacgtaaaaacaccagctatgctagtggatatttattcttttattgtatcttgattatgataatattcaagcaattaccgtcattcttaactatcatataaaaagcatatacttttgattcctctacaaagatgaattaattatattcaacattcatttcagaattaagtatacttacgcttacttatggcaagtctgttaaagcttgcgacagaccgtaagctgctcgtcagcgcgggaagcggcttctataatatggaaggaaacacacgcatcggaagatgcaactgtccaaaggaggcagaaggcttaatcgatatgatgctgcatgcacgtatgtaagaagataagaacagacagaagccatacaagccggtttctgtcttttttcagctgcgttgcaaagctacctacatcataagggcgtatccctgctttatgatgaaaagaagtaccctatatcgacttaagaatgcttaagcatttcatcctatacaagctgtacgatatatgctataaataatgcagatgcatccgtttaccggtatggaaaaccatcggattcacggcaatttcctgctcctcctcatcggataaaggcaatttacacatttatcattatcgtgcacacgatacaggaaaggggtattcaatgaacctatatcttacagatttcaaccaaaatgccacgctgatacctatttttatgcacggactggcgatttccatcatgctgacagtggggacgctttccatgctgaaaaagaagaaggtatgcgacaaacgctatttcatctgggggcggatgaaccacatagcatgtgctgtgcttctgatctggatcataacgacaaagggatatggtcggccgctggaatttttattccttatcagttttgtcctgctcctgtatctgctgctgttgatcaccctgattgttaattgtttaaaaatcaggcacagagggtcagcttcatgagcttgcaagacggtctgttaaagactgtaaggtctgcatatcgtagaacggtatgtgttgggaatacacgacagtaaggatatatgatacaatagcgctggatgcatacagctgcagaagctgtactacacaaaaagacaatagaacataaagaaaagaggtatactatggaaacagcaatcgaaagagtaagagcttttgtaaaggatcgcgattgggatcagtttcatacgccggataatctggcaaaatccatctgcatagaggcaggggagctgctggaatgctttcagtgggatccggagaaatatgaacatcgcgcggtgtgtgaggagcttgcggatgtgatgatttactgtatgcagctcgcggataagctgcaggtgaatatggaagacatcattctggataaaatggaaaagaatgaaaagaagtatcctgtggaaaaagccagaggaaatgcagcgaagtatgacgcatatgaataaacaggaggcagctatgaaaaaactgtatatttctgcggatatcgaaggaatctggggaaacggggcctttgcacatactgcgaagaatggcacagagtatgaggaataccgcacgaatatgatttcggaggtaaacctgttgattgataagctgtttacggcaggagctgaggaagtcgtggtgaatgacggtcatggcaatatggataatctgagcgcatcaagactggacccgcgtgcctgtatggtggtaagcaatggtgcctataaggaatatgggatgatggagggactggacgatacctttgacggtgtatgctttgtcggatatcattgtcgcagcaatacccgcggcgtcatggcacacacgatatggggaaccttggtgagaagcatccgcgttgacggcgaggaaatgggagagagcggcatcaatgcccgacttgcctgggaatatggtgttccgatcgtgctcatcagcggcgatgatctgttgaaggaacagctgaaggaggaactgccgatgccgtttgcttatgtggaaaccaagcgtgcaatctcttcccagtgtgccctttcctgcagctggcaaatgctggaggaacgctatgagcgtgccgtttcatccatggaagcacattgtggacaagcgcctgtctatgccaaaaaaccacattgtgtggatatcacctttcatcatgaacgcaatgccgattttgtttcccgcatggacggcgtgacacggatatcggattgcacggtacgcatacagaaggacagctatgatgaagtataccggtatcttcgctttgttataaaaataagcaatgcatttgccgcataaaagcagagaaagcaggtgaagccatgaagcagatgcatattctggatcagatgaaaccggaggaggtcgcagagctgaaggcgcagtctgtcacgaaaacgtttcagcgccgggaaatcattttccataaggaagacacgcccaaatatttgtatgtattgctggagggtgcggtttgtgtttttgatgatacaccggacggtacccgcaatattctgaccatcatacgggagccgatggactgctttgcagaggtttatctgtttattgatgaaaagcttcccttttctgcggaagcgatgaagaaaagcacggtgcttatgattccccgcagtgtgctgcaccggtttccccgaatcagccggaatctgaatgtcatgctttcacaaaaagcatatacgctgtcacagaagctgaagctgttaatgaaggacagcctgcgtgaaaaaatcatggaatatatgcagcagcatcccgatgtcctgttgaagcgccatgagctggcaagctttctcggtgtcagccgaccggctctttccagagagctgtatcgcatggtggatgacggacttctggttcttgatgagcatggaaactttaaaacggtaatatagattaccgctttttttctgtctgcgcgatatacttgcttcgtaagcaaggaggcgatatctgtgaaaacagaaacaatacaggaaatggcaggaatgcaggacggtgctatcgtgtcgaaagtactgacgcaaaacggaagcacaacgctgtttgcactggctcagggagaggaaatccaggaacatacgagtacgcgggcagcgctggcaatcgtattggagggacgtattatattcaccgttgatggagaagaaaaggaaatacagggtatggaggcagttcatcttccggcatctgttgtacatgccctgcgtgcagacacaaacagccgtatgctgctgatacagaagggagagcggtaatatggaagaaatgttttgctttcagtgccaggaaacgatgaacgagacggcatgtaccgtacagggcatgtgcgggaaaagtgcagcgtgcgccaatctgcaggatgccttgatacgggcaagtcagtatgccgcattatatgatacagcatcggacgaacagcttatgaacaatctgttcatgacgataacgaatgctaacttttccacagcggatatccgcagggcgattgaaaaaacatataccggaaaatctgtggaggagctgacacgggagggatgcctgaagaaccggaaagagactgtgcgttccttgcaggagcttattttgtacggactgaaggggctgtgcgcctatctgtcgcatgcagctgtgctgggattccggaaagctgagctgagcagctttgtccgcagcacccttgtatatttgctggaggatcacgaacaaaaggagtatctgacattgcttgataagaccggcgagatgggtgtacaggccatggcactgctggatgaagcaaacacagccacctatggtcagccggaaatcaccacggtatctctggaaacaggaagccgtccgggtattctggtatccggacatgatctgcatgacttaaaggagctgctggaacagtcacgctcacagggaatcgatatttatacacatggggaaatgctgccggcgcattcttatccggaatttaagaaatatgagcatttcaaagggaattacggaaatgcgtggtggagacagaatgaggaatttgaagcattcaacgggccgattctgatgacaaccaactgcatcattccggtaaaggacagctacaggcagcgcatctttacaaccggtgttgtcggatatgacggacttgagcatatagaagcagtgaatggaaggaaggacttccgctgtattatcgaactggcgaaacactgtcctgcaccgcagcagctggaaacaggaagtgtaaccggcggctttgcacatgcacaggtcatggcgttacaggatcaaatcgtggaagccgtaaaaaacggggatatccggcagtttatcgttatggcaggctgtgatggacggcatgcctccagaagctactatactgatttcgccagagcacttccaaaggatacggtgattctgactgccggatgtgcaaaataccgttatctgaagcttgatctgggaatgatcaacgggattccccgtgtgctggatgcgggacagtgcaatgattcctattctctggtactgattgcagaagcactgaaggaggcctttggcttacaggatatcaatgagctgccaatcctctataacattgcatggtatgagcagaaggcggtcatcgtattgctggcactgctgcatctgggtgtgaagaatatccatctggggccaacgctgcctgcctttttgagtcctgaagttgtacagtggctaaaggagagctatggaatcaaaacgattcaggaggttgaaaaagatatggagaatttcggtattacgaaacgtgaaccatcctatggagatatgacgatggctgagctgttgaagctggatgaggggatggaggatgtgctgtatgaagcaggctttcactgtctgggatgtccaagcgctcagcttgaatccttacgcgatgcctgtgagctgcatgccctgaacgttgatgaggtgtgcgcagccatacgggagtaccgtcatgagtaagcggctgggaggaattcatcagctgctgtataagcgcatctgttttctaagcgaatggaatgaagccttgtgcagtgcgttgcacagggaacagaagcatcgctgtcacaggctgcagctgacagatctgattgatgaaaccaacattcatgaaagcctgcaggaaataatgaaagaggtacagcgcgagcatgctgcgttaagtgagcgtcttgtccatgcgcagggaaaagaggctgctgcgcaggtgattgcaggctttggacagcggcatacagtggatggcgatctgacacagctgctgaagcagatcgaagcactgtttctacatggaatgccctgtgaacgtaacctgatcatggaagtgcaggatgatacacatgcacgtattgtatggaagaatgattcccagctgcagtattaccaaaatccttccttatggctgtgggagcgggaacagctgcttcaaaaaatgcttccggcaggctatgtatatgaggagtatgcaaaggaagcagttttatataaagatgctgtgtcccgtacatgggtggaacagctggaatatgagcatgaaatgatttcacacctgctggctgccatgcaggaatactcgctatccatactgcggacaaagcaggtggacagagaatggctgaaaaactgtcttgattatctacaggaatatgcggatgtctttcatcatcagaaggaggaggagctggtgttcagccgtttgaagcaggcaagtccgcaggggaaactccttgtcgaacagggaatgcttgtggagcatgatctcgcaagatattacatccgctccatgaagaagctgctaaagaaggatgtcactgagaaggtctgtgtacgtctgatcggtttcattcaggcatatattgatctgcttgaacgtcatattgaaaaggaaaacagtgtggcgtatccctatgcggtgcgtaagcttgcgatggatgagattcagaaagcgttcgatgcacatggtcagtatgagcgaatggaggagttaagggaattcttgaagctgtcctgatggatgcatagctacatctgatttcctgtcatagagaaaaagaaaacctttctacaggtgtaaggacacgggctatgaagttcttcacagcggtgttgatatctagtagaaaggcttttttctatacaggtgtttattccagagagcctgacgtatttgctttatgcttcaggtacagttgcttcagctccttctgataaaacagcagaaggaagatgagggccgcaagacctcccctgaggagataaagcagggcggttttattgtcattgtaaaagataaacagtacggctccgcaggtcatttgatagcctgtaaggatgagggatgcaatcatgagtgcaatgcttccatatcttatatatgctttcatatcggttctcctatctaacctgccagtgtcggcgagtcactgatttctttatcaaaggtaaaattgatgccgtcctttgatttatagcgtcccttgacaagagcattattctttatataatcgccgtctgtaccctgagcgacgatcatataggttattcccctctcctgataaacatattccatctgaacgaatggcttgaagctgctgcccaatatctccacctcatgagcagggattgtcagtgtggtatacgtatttccatcatcctctgtatagtatacaagcggatttccctgttcatccgttccggcgccgatgtaggcagtttcatcggaaagaaagataatgtctcttttctcattcaatactttaccaaacagctgtttccaggtttttaaatcgctgcttttaaacgtgctgtaatactcatgaccgagtgaacgatctgtcgccagtgtgatatagcagctgttttccgtttttgacagataaagcgtatctccgcgataggttcttgaaataattctgcttttttcccatgtctttcccatatcttcactgtattgcaggtagcttccggtttcgtcataacagacaaaggcagtaaagtccctgcttacaatatatccatgtgcgggaagcagttcattgtaggtactgttatttgtacctgcgatatcctcatagggtaccggaacctcggtaaagcttttccctgcatcataggtgacatacagctgattttgagagaatgcataggtttccttcctgtcagccatcgcgtaatgcgtggttggcggtttgcgcagggaagggtctgtctggatttgatactgtaccggtgacattttgttttttacagtatatccattcaatgttttctcaagctgtaatacaacctgcgctacataccagccgttctcctgcaaggcggcggtatagtaggatgtgacataagggttatcgcttgcgggcctgaattcataatcgagctgtacaaagccctcttccttatttaagacttcaatggtttttactcttttatccctgatgcggaattcaaaggggacaaaaggtccttcatattgcttgaaaaactcagcaaaccattgttcggtgactttctttacatccgtgttttccgtttgtatgctgctgccgataatcgctgtgggattgtattgattccagataccgtacagtaccatagcggataccccgcaggccatcagcagacacagcagcgccagtccgattttcttcatgctatgcacttccttttttcatagtatagcacaggttgacagcgatagatacatgaaatatgatatggtaaaatgctatgatttccggtttcttgaaagtcatacacctttgttgatgtatgccctttttgatggcacacccgtcgggtatacagccatttccgttatttatcaataaacggaaaagcagtatgtttttcctacggtgatttcgcaaacggacaaaccttgcaaatagctttctctttttatagagacatgcggccctgagcgatgtttcggctatgcattattgtgcgaaatcctttattttatgtatttttccttgtctttgcgggaagaattctatataatgatactgcaaaggtaatgacaggaagagtagcttttatccaaggcgaagagagagaatggctggtgtaaattctcatgaggaaaaagcgaacatggccctggaaccgtttttctgaataattaggaagaaccgcaggccggcgttaacggcaaatgaggtgtacgtgtatgcgtgcatgaataaaggtggtaacacgaagctttcgtcctttggcgggggctttttcttatataaggaggatatgaatatgtgtaaggaatgtaagaacaaaaaaccatactacatcacaaccgcgattacctatacatcgggaagaccgcatatcggtaatacgtatgaaatcatactgacagatgcgatcgcaagatacaagcgccagcagggctacgatgtatttttccagacaggtacggatgagcatggacagaaaatcgaggaaaaggcaaaggaagccggtgtaacgccgaaggaatttgtcgacaaagttgccggaattgtgcgcaaaaactttgatatgatgaacacatcctacgattactttgttcgtacgacggatgactatcacgaaaagcaggtacagaagatctttaagaagctgtatgaacagggcgatatttacaagagcacctatgagggcttatattgtacgccgtgtgaatccttctggacggaaagtcagctgattgacggaaaatgtccggattgcgggcgtcctgtggaaaaagcaagtgaggaagcatacttcttcaatcttcagaaatatgcaccgcgtctgatcaagcatattgaagaccatccggaatttattcagccggaatccagaaagaatgagatgatcaacaacttcctgaagccgggtctgcaggatctgtgtgtatcccgtacatcctttaaatgggggattcctgttgattttgacccgggacatgttgtctatgtctggattgatgccctaagcaactatatcacatccctgggctttgacgctgatggaaaccatggggatctgtataaaaaatattggcctgcggatgtacatatcatcggtaaggacattctgcgcttccatacgatttactggccaattatgctgatggcactcggtgagccgctaccaaagcaggtgttcggtcatccatggctgctggttggagatggaaagatgtccaaatccaaaggaaacgccatctatgcggatgagcttgtgcattacttcggtgtggatgccgtgcggtatttcgtactgcatgaaatgccgtttgcacaggatggaacgattacctgggatctggttgtggagcgtataaactctgatctggccaatgttcttggaaatcttgtcaaccgtaccatttccatgcagaataaatacttcaacggggtgatttccaatccgctggagcaggaggatatcgacaaggagctgattgctcttgctctggatacgccgaagcgtgtggaaaagaaaatggaaaccctgcatgtcggagaagcaattgatgaaatctttaccctgctgaagcgctgcaacaagtatattgatgaaacgacgccatgggtgcttggcaaggatgaagcgaagaaggatcgtctggcaactgttctgtataacctgctggaatgtatccgtttctctgccgtactgctgagcagctatatgccggaaaccgctgagaaaattcttgaggagctgagcacatccgagcgtgatgcagacagcctgaaggagtttggaatgctggaatgcgggcatacagtggaaggaaagccggaaattctgtttgcacgaattgatgcgaaggagtttatggaaacactggaagcagaccgcaagaaggaagaaaaagccgcaaagaaggcggataaaaaagaagcgaagaaagaagatgcacctgttgaacaaatcggaatcgaggattttacaaaggtggagctgaaggttggaacgattatctctgccgaaaagcatccaaaggcggacagattattggtggaacagattgatctgggtgaggaaacccgccagattgtcagtggtattgccgcaagcttttcaccagaggatgttgtcggaaagaaggtcatcgttgtgaccaatctgaagccggtcaagctgcgtggtgtagagagtcagggcatgattctgtgtgccagcaatgcggatgatctggatattgtaacgattgttaaggatctgccaaacggaacgaaggtgagctaattgcaaacaaaaacggtactgcctgcattactgacagctatattcgtatgtctgatttcctgtttctttatctattatggtatcgacagtgatcagatcgtgttgtcggtgatcggtggggcattgctgattgttgggattttacgtctggtattgtttacgaaagcatatcgtgagcaaaaagagaaataagaaagtatgaagaaggattccatttctgtcataagagatggggtctttttttgtatgcgtacatatggagaccgggatttttttaccgtgatggaatggtatttcttttagagggtatggaattgcatatcgctttgccggattactgtgaaatggaggatgtgtatttcacttatagctgtcataagcaacaggaacagctaagcacaaatcactttaatgaaataccgcaaaatacattaacgaaaaagcacaaagtacattaattgaataccacaaagtacattaatgaattatcacaaaaggccgaaaatatcctaattttaaaaaatcctcttttctcaaaagaagaacttttttgtgtattatccgtatagataaattagacttgacatacttaggaacaacatatcgaaatttttaatttctttaatttccacttttttcgatagctcaatacttaactcgaaaaatgatggacagtcattcacaggtttgaattgataatatctgcataatgttcaaagatatcatttatatacaatacctattgtaattttgttactaaaagcatgtaatttttgtaacaaggagtgatgtgttgtgggagaaaatcttatgatgaaaatggaagaacggatgaaaaactcccccaaaggcactattttcacaaacagtgatttctatgatataagcaatccggatgcagttaaaatgcctcttcacagactatacagcagtaataaaatataccggcttatcagtggatattatactatcccatactacagtaatgttttacatgaatatggatatccttcggcaaatgctatggcagaaaagcttgctgagaagtatgcatggaatatctgtccgtctggagtggtatccttcaaaaagaagttttatccatgtaattgggcacgatatgatttagtattacaaggcggctgcaaactggtaccgaaggaaaatgctatcgcatattttggaaaggattataaggcgatgagcaatatgatttatggtgaatccataccctgtgaaacaatgatgaaaaggatacagcaattcgaggagcaattaaataaaacggtgctagatcaaataaagatacaaggctaattcattgtaatcgttctttaaatgtttcgttatctcttttacttacatatttattttgatgttgcataattcaaaacatcatataaaaaagggtaacccatttttatatggtgttcacccttttaaatctttataagctgcgtcccagctcgtacgcctctctcggataatcagattgctcaatatcctctctgacatacattcccaatgcatacacactgccgatgcatgtccaccgcatatagcggaaagcatcttcaaagtggtgctttaatgcatcaaatgtccagtcctccgtatcgccgcaggtagctaatacaatggtttttttctgctgttcccgtaatgcagtattgttcgcatagaagcggtcgaatacggctttgatctgtgcactcattccgaaataatacaatggtgttacaaacacaaccagctctgcatccgcaagcattggattcagcttttccattccatccttaaacacgcatccgttaccggtcttacggcatgtatcacaggcaatgcatggatggacatcctctctggcggcatgaaacacatggatttcatgtcctttttcctgtgctccccgtataaactcttccatcagtagtgcagaagtgcctttcacatgcggacttccgttgataacaagtatgttcataatctgtgctccttttcctctttattatgtatgataccacttcatgtcacggaagtaaatcggtcaaagaatacccaaataggatattcatcaaaagattgtatctgatcatcctatgtaaccattattgaaacaacagatattgttatataatggatatatcgatataatataaaaacagtaattaaatagatttctgcggttaagatgagttaaaaaacaaaataagaatatggaaggcaaagcatttaatgcagagtttatgaaaacgaaaacgaggtgaaaaaacatgaaaatcattacggtatgtgggagtctgaaattcaggaatgagattatgaaaatcacagaggaaatgacattgcagggaaattgtatgttaagtattgtatatccgacaaattcagatatagctgtgtatacaagagaagaaagggagctgcttggtgacatgcataaggaaaggatacgtatctccgatgcaatccttgttgtggatattgatcattacataggaagcagcacacaaggtgaaattgagttcgcaagagctttagtaaaagaaatcatatactatacggatattgtaggtactatgtagtgattatttgtttctgaaattttattttttacagattggtattttgcaggaggatagcaagcagacagtctcttcatcttatccgaagggaaatgacataagaaaccacatgtttcgtaaacgttaagaaaaagcatgacaaaactgtaagggaagggtaaggaaatcgtatggtatggataagctttctgcgatatactgttattaacaaaaggaggctgaatgcatgacacaaaaaacgatgtccgttctgcttgccactgcctttctggttggtgttggatacaaggcgatgcgccacgtatttccaaaaagcagataatcagtatacgaatacatagggaatctatgaaaagccgcagaaatcatctgcggtttttcatatacctgtgtgatatgaaaatcgctgtaaacatcaatagctgctggtgccactccataaccgtctgacccataaacgattctctgggaaatttcctgtaaaaagggaaaaattcctacttctgccaccttggaacgaaacgaactggattgcttgtggatggtaagccttttacgatacaatagcggtgttaatgaaaacctttacatgtaattgggagaattggaggatgttatgaaacagaagattcaaaaatttggaggggccatgtttacaccggtgctgctgtttgcctttgccggaatcatggtcggtcttgcgacgacctgtatgaatccgcagatcatgggggatctggcgaatccggaatccatatggtacaaattctgggcgatgatcagtgccggtgcgaatacggtattcaatcagctgcctgtcctgttcgcagtttctctgccgattgcgcttgcgaaaaagcagaatgccagagcatgcatggaaacctttgtgatctatatcacgttcaactactttgtcagtgaatttttaaaccagtttggcgcttcactgggctttgattttgccgctgaggtaggcggtaccagtggtcttgccatgattgccggcatcaaaacgctggatacaggaatgattggagcaatcctgattgcaggtattgccatttatctgcacaataaattttatgacaaggagcttccggattatctcggtgtcttcaagggatctgcctttgttgtcatgatcggcttcttcgtcatgattcctgtcgctatcctcattgcacttgtatggccgcatgtacaatccgccctattgggtttgcagggcttcttcaaggcgagtggcgctgttggtctgttcacatataatctgttacagaagctgctgctgccattcggtgttcatcactttatctatgcaccggttctgtttgataacgtcattgtggatggtggtacgatatcctactgggcacagcatctgccggatttcgtcaactcctccaagccgctgattgagctgtatccacttggcggcttctccaacggagagcttgcgaaaatctttggtgtcatcggtgttgcccttgccttctataaaacggcacgtcctgaaaaacggaagatggttgtcgcactgatggtgccagcctgtctgaccgcgatgatgaccgggattactgagccgctggaattcacctttctgtttgtggcgcctgtgctgtacgttgtctattcggtactgtccgcactgcttgcggtggtcatgctgctgttcggggtcataggaaacttcggtcagggtattcccaacatcatcttcctgaatctgataccactgtttaaaaatcatgaaatgatgtatgtctggatgcttgttatcggtgttgcctttactgcaatttactactttgtattcaaattcatgattctgaaattcaattacgcaacaccgggaagggaagcggtggatgaagataccaagctgctgacaaaggatgagtacaaggcattaaaggatgagaaaaagagcaccggaagtgaccgctttgatgtaaacggcatactatccgcactgggcggtggagacaacattctggaaatcagcaactgtgcgacacgcctgcgtctgcttgttaaggatgaaaaggcggtacagagcctggaagagtttaagaaatacggggcaatcggccttgtgaaaaacggcacctccattcaggtcatcatcggtctggatgtaccaaaggtaagagaacaggcagagcttctgcttggaagagaataacgagtatagtttattacgacagcccttaacaacggctgataaaggaggatactgatatgaagaaattttcaatactgattgcaggaggaggaagcacctatacaccgggcatcgttttgatgctgctgagccatctggaccgctttccacttcgttcaatcaagttctatgacaatgatgcagatcgtcagaaaattgttgcggatgcatgcgaggtcctgattcgtgagcggaatccggagattagctttctggcaactaccgatccggaaacagcctttacggatgtagacttcgtcatggcacatattcgtgcgggaaaatatgcaatgcgtgagctggatgagaaaataccgatgaaatataatgtcgtcggacaggaaacctgtggacctggaggaattgcttacggtatgcgttccatcggtgcgatgctggagctggttgactacatggagaaatattcaccgcaggcatggatgctgaactattccaatcctgccgcaatcgtagcggaggcgacaagaaagctgcgcccggattcccgtattctcaatatctgtgatatgccaatcggcattgaacgtcatatggcggaaatcctgcatctggattccagaaaggatatggacatctcctattacggactgaaccatttcggatggtggacgagtattaaggatcatgcgggaaatgatctgatgcctgtattaaaggaacatatcaaagaaaagggatactgtgtggaagcacagatgtatcagcacacggatgacagctggacagataccttccgcaaggcaagagatgtctatgcactggatccggataccctgccgaacacctatctgaaatattacttctacccggattatgtagtggaacataccgatcctgcctatacccgtgccaaccaggttatggatggccgtgaaaaattcgtattcggagaatgccgcaagatagcagaggcacagagcagtgagggagcggatctgcatattgatgagcatgcatcctatattgtcgatctggcatgtgcactggcatacaatacgaaggaaaaaatgctgctgattgtggaaaacaacggtgctgtacaaaactttgacccgactgcaatggttgaggtgccttgtctggtgggaagcgatggaccgcaggcgctgtgcatcggggatattccacggttccagaagggattgatggagcagcaggtcgctgtggaaaagctggttgtggaagcatgggcggaacagagctatcagaagctgtggcaggccctgacactgagtcgcatggtaccaagtgcaagcgtcgcaaaagcgattctggatgatctgatcgaggcgaataaggattactggccggaattaaaataagaatctgaaacttatgttatagattatagaagagaacacccgtggttgcatacgcttatgcatacgggtgtttttttgctgtaactgcgtgggaatgctgtgatctttttcagaattgctggtttatgatggaattcatgatataatcgtagagaatgaggtgaaggatcatgaaacttgcagagctagtcaatcagcattataaggagctgtcctccaatgacctgtacatttgggactatatacaggcgcatggaaaggaatgtcagaatctgtctatcgttgagcttgcacagcgctgccatgtttccaaaacgacgatcctgcgctttgcccagaagctgtcgctgaagggatacagtgaattgaaggtatatctgagctgggaaaaccggccatccggggatatggtgattgatgagcatctgattgagcatgtatgtgatacaagcaaatacgccattgatgagctgcgggagcgtgatttcacggatatctgtgaaatgctgtatcactctggacgcatattcgtatatggaacaggagccttgcaggattctgtggcaagggagctgcagcgtatgtttttatattgcggagaatttgtctatgttctatccggcgaaaaggaaacggaaatggttctgcccttcttgagccgtgatgatgttgtgattctgatttccctgcgcggagaaggggagctgatcaatgagtttgcttctcagcttcgtctaagaagcatcaaaacgatatccatgacgcgactgaaaaataatgagctcgctcataaatgcacgaaaagcatctacatcacaacctcacaggtgatgattggcaatcatattctgcatgaggcggcaaatctgtattttgtattggcagagctgctgtttctgcgctattcccaatataaacagaagcaggatggtataggaatacgataaccgcaaacatggcggttttttctttgaaaactcttgcgggtgacgcaggggaatagtctacaataggggaagaggtgaagaatatgtatcagattcatgaggtgtgcgaacgctgtcatttaagcagaaaagcgattcgtctgtatgaggaaaaaggactcctgcatccggataggatacagggaaatcgaatgtataataaagaagatgtagtgcggctgcaatgtatcagctattatcgtggacttgggttttctctggaacagattcagcagctgttgcatggcagcagtgaaaaatgtttgaaggagctgcttatgacacataaaaagcagctgaatcaaaagctggaggaaaagcaggaacagctgagggctgtaaacaatgttatacatgtgatccggcagcatgaggaatttgatatcactgcagcggtatcggatgaacagcatgacgatgattgtgtggaggggatgctgatctggaagtggaattccatctatcagatttataactatcgatgcagcagaaagacctatcggcatgcggttatttccacacggctgttttgtgcgattcttgtaattgtactggtgtttgcatggctggagaagggaggaattctgtaatgattaccatacgtgagcttgcggattcctgcaatatcagtgtacggacactgcagtattatgatcagattgatcttttgaagcccagcggttatcaggggagcattcgtctgtatgatgaagcagcaaagaaaaaactgaaatgcatccttgcatggaaggtactgggcctaagtctagaggaaatcacaaagcttcagcagggagtcatggatcgggaacagctgttgattctgctggaacagaaaaaggaacagcttatgatgttcaaggatgctttactaaaaaatcagatgcaggtggatgacatattgtttcatatccggcagtctaaggagtggaatcccggcgactatatggaaattttatcactgcaaactatggatcatccgtattcactgacaacacatctggttgcactgctgcgtaatatgacgctgctcaaggtgatcattttgatattttacatattgaatgccctctgtattgccgcacttatcgcagaatgtgcaacccttctattcccatagggcaataaatcataattcagatgctttgatagaaagatatggaaagcggcaatgggcttattcatattcaaattcggaacgatttcgtattcatgcagaggctaagctgaataagaagataatcttacacatccgtcgtttccctaccgggtaaactgttgtataatagtgatattgatcatacaaggagacgaaggatatgtcacagaaaaaaattacctatatcaagctgctgcatcagctggaaaaaaagatgaagaccaaacgccttgagggcaaggtcgctatacaaagagaagaatttgaaattctgttgtccggaataccttcaattttaaacggatacgatctggtaacgcttgaggtaggtgaaaacatcaaccgggaggcattgcgaaagcatctgaaggaacagtttgaaatcaccgataaagagagtgcaatcagggcaatcaaagcctttttgaatgataatgtgcaatggcagtacgagcagtttctgggcttctggagggatgagcctcagttcgatttggaagagctggatgaaaaagcaaggctgttctttgagggctgcaaaacctttgcgaagcagttttacccgttcctgaaggatcagggctttgccggctttgattatggagaatgtgtccgcatgatacgggaatgctatgcagtggaacttctggatcgggaaacggcggacatgatgctgcaggatatcggaacccgtgcattccggcagtttgacagatgggaggaatatgcgctcagttatctgtgcggagggtgttatttcatgttccgcagctccgggatgaacaacgattatggaagtatgatgtttcaaaatgagctgcaggcgattgaaaagctgttttttgaaaatcgtaccaatgtatggaaccgctattcctggctggagggaaagaagtatttcccgggcatgaaagaagggaaaaagctgattgacagcacgttgggctgctttgtgacggatcgtgtcagcatagatcaggatgccatctgttatatggtacgcgaggagccctccaaagacaatccggacagcggctggagaatcttcgccggagatgaaacacaggagtatattgatgatattgaacatacgcaggttttcgctttaaataccgtatgcaattatgatccggaaatcatcccgtttcttgacgagccgattggtacggtgattgtgcgcaatcgggaaggaaagcttgaaaaagaggaaaagcagaatcaataacagctgtttttatgggaattcacactctgtttactgtatatccgctatacagcttataccgaacgtaaggtttggacatgatctgaattcagattgtccggacctttttcttcatattcatttggtcctatggtaaccggtatagtcataaatagtttaagaaaacagatattcgacatagttgttattgacagaatacgaataccatgatagtgtattactgtatttagtacactaatacactggaggtgcaattgatgtttgtaattgacacgcaaagcaagcttccgatatttgaacagctgaaaaagcaaatactggagtttatcacaattggtattctatcaccaaatgacaaacttccttctgttcgtgccatggcttcgcagattggtgtaaaccccaacacggttgcgaaagcctatcaggagctggaagagcacggatatatttattcggagaaaggaaagggatgctttgtggcagacaatgaatccgataagctgatacgggaagaaaagctgaaggactttaagggaacagttcttgatatgaagcagcatcatatcgaaaaggaagcgctctataaagtggtgaattccgtatatgaggagggaaaggatcatgcttaaaatcaggtcactgacaaagaaatttaaagaaaagaccgtgctgatggatgtaaacctggatattcacagcggcagtgtttttggtctgatcggtcccaatggttcaggtaaatccacacttctgaaaattatggccggtattatgaagccggatctgggatgtatctgtattgatgatgaaagggtatttgataatcccaatgtgaaacgtgatattctgttgatcagtgatgatccgttttatttctttaatgccacgttaaaggatatgaaggaattttaccgtgtatggtatccaaatctcaatgatgaaatctacgagaaatatcgtgctatctttaagctggatgaaaataagacactgaagaatttctccaagggtatgaagcgtcagtcctttatcgttctggcacttgcaatttcaccaaaatatctgtttcttgacgaggcatttgacggtctggatccggtgatgcggctgacctttaaacgggcaatcagtaaaatgatcgaggaaaaggaaatgactgtaatcatatccagtcataatctgcgtgagctggaggatatctgcgatacattcggtatcttggaggataatacgattcgaactgccggctatgtggatgaaacgaaggaaaatatccacaagattcagcttgcgtttaaagaagaaaaacgtgaagatgattttaaggcactggatttgctgtcgatgcatgtgcagtcgcgtgtagtgaatctggttgttaagggagatattgaaaaaattaaaaattatttgaatacgatggaccctctgatgatggaagtgctgaatgtcaatctggaggaggtcttcatctatgaaatggaaaagaaggggtatggtgtttatgatgaatgattttaaggcctatctgcgctattatgtaaacagcaataaacggctgttgatactggtttttatcattctgtttctgataatgccattcttcacctttaattatatgggactgccacgcggcccgtattcactggataccttttatatgggattcattgctctgggagcggcaacctgtgctggaggctgtatcctgtcatatctgttaccaatatataattttcgctatttgtataagaaaagaagtcatgagatgtacttctctttaccgatacaaagaaagcatctgtttctatacaactatatcagcgggctgcttgtcgtactggtcccgttgctgatgaactatcttctgggctactttataatgctggggctcggatatcgggagagaccgctctatatgctgataccgttaatcttctttctcggtttatccatcctgcttttgattcagtattccattttcacctttttaagcgtgaaatgcaacaatctgattgacagtattcttgtcaacggtgcttacgttgtcatgccgtttattgtcatgctttccgcgacgattttctttagtaatcagataacggcaattcttggagatatcggcgcatcaccaagtgaatttatcaatatgggaatgatccagatgctgctttccatgccgagtacaatatatgcctttctatttaatatgatagcttccatggcgtcggaaatgcatagaattgatactctgataaacgcatttaactggctgtactttctatattggggagtcatcggtgtgctgtgcttctggtttggctggaaatcctttgtggatagaaagcctgaggatgcagagcagcgaactgttaccttattcggatacccggtgattatcacggttatcaccttctgtatggttttattcgtcatgaatatcaatggcggtgtcgttgttcccagcctgattatactggttgcatatttttgtatgatattcttctccaatcgaaagatacagataaaaaagcttcacgtaatcgtatttgcattgctttatatcggaaccttcggctttagctatatgtatacgcagacaaaagggctggggatggtaaaggaatttccatcgctgacagacatggtgcgtgtaaatattgatgtgaatgcatcttctattgaaaatgattccgctatgcagttctatgatgcgaagaataaagaatattatgatgggtatggtacttctgttcaggatgaggaatccatgaaagatctgctggatgtgcaaaaggaagtcagtactaggagtgtgaaggagtacttttatgataatgcgttttatatcagcatttcctatatcaagcaggataactttcaggtttctcgaaactatacactaaaaatgaataaaaagaataaggactatctacaaaagctgatggaagagctgaagcatacggaaaaattctctgttatgcagcattgagaaatgagctgaaagtaagaaaatctttcttgctgttcatagaaagcatgaaggaaaaataagtcattcttttaccacaaaaggaaggctttgctgttgaatgaaaggggttctattgcataatagagtacacaattcgcaaggggattgcgatacctcttatagtaagcaaaaggctctcagcacttatgtgtgcagagagcctttttgcgttgtacatctaaaacagtaacacacaatgtatgtatttacaaatgacagcttatatcgtcgtgtcggacttgcttattcgtttttttacagactcgaaggtatcacattccagaaccaatgtggatactatatgcatttgttcctcagttaatgcctgcagccacattgcgcaatcctcatgaaacttgatttgcatctgtctgtgtaagagctgcctctctccttccagcttaccttccatttttccggcagcttttccctcttcaaagctgtcacgcaagccgttgcggtaacgtgcttctcccatttgaatcgccattgcggttgaccatagctcatcatccttctgcatttcctcgtacttgtccatgaataccttcaccagcctttccttcgacttcagtatatcattttttttattattttcaaacaggtatatcagctgttcaaagtcattcagtctctgcatttccttctcctttacaatgtcattgattgccggcatatgaacaaaggtgcgaaggatgagtgggtagtagctttcattctctccctgctcattgcgcatctgatactgattgatcagatttctgttgttccatgcatactcatcaatgaagataatttgataaaccggctttaattgatcataaagctcaccgcttttcagctgattgttcaacgctctggcaccgtaaaattcaaagcgcatcatttccgctaaacctttgtaggttgtctgcatctcgatattgaaatgacggttttgttcatccttcacgtggacatccagaatgatgcgcttctttccgatgatgcccgggtccagattcggattgaggacggtgctttcctttaccttgattccggtaacacgttcaatgatggtgttgcgggcgtacacagagccttcatcctcacgggaaagggcgtacttaaaaaatagatcgttactgtagttgagttgattccttgcatttgacatttatatgtcctccattctgtaagggctccttacccccttctatacgtatggaatctgtcaaattcctaaagaatccacgaataattgataaaatttgttatttttcacgttaaacaaagtataaatttctaattatctttttatattttcttaaatgctcgtaaagccttattctatgtgctttcgagtatttttactgtaggaagatacttcacgtttctttgcatatttcctcatgtcttagctgtcagaagtggtaaataagtagtaaattcatttgtactactaagcaacaagacgctcctgttgcttctctttattcaagcgtttcatttctgccattgcagaatcgaatgttgcatgtgcgtaatagttcagcgtcatggctatattagcatgtcccataatgtactgtaatgcctttggattcattcctgcatttgcatagttggtacagaatgtatgtcgcaaactatgtggagtgatgtgtggcaatttatcctcgttatacttattgtatttcttaacaagacctttcatcatgccgttgtaatcacttgccacttttggatagttctttctattaagaaagaggaaatcactatatccatcaatctcaacacgcttatcattctttcgattcgctaacactcgcttaaatgcttgataggcttcttcaaccataggaacttgacgttcgccacttttggtctttggtgtttcaatgtagtacccaatttcagtatctctcaatagctgatggtctatattgacaagacgattctcaaaatctaaatctggaagtgtcaaaccaccaaactctgaaatacgaagacctgtttttaagagtatcagaatttcatcataatttttgctgtaggttttatcagcttttgcaaaggctaacagtttttcttcctgttcttctgttagtacggtcttagggacagtatcatcatcaagaactgctttcagttgaaagtcaaatggattcttccgaacacaatcatcttgtatagcaatatagaatgaagcctttaaagaacgtttgtagttattgatggtttgataagcataaccattttcactcattctaatagcccattctttagcgtctgatggcttaatactgtcaatacttcttacacctaacttgtctttcttcaaaatatccataagatatttgcgtccagtttcagtgttttttctaacctttggtctttgagcgttctgttttgcgtaaagctggcagagtgtcattttctttcctacaacatcaataccatcatgaatgtctttctgtaactctgcgattttctctctaagtgagatacaatcacgctttcctgctggtactcggtctgtagccacaagtttccacgagtaaacaaattgcggttctccaaatgaatctatatatttgtataagtatcttccgtcttttcgttggctctctccagtctttaagattcgacctttattgtcacgtcttttttctgacatggcatttgctcctttcctttatggaaagagccttgatacgacttaatactattttatcatatacaagaccctttggcgacgctagattgcgtccaatgtatctataattttttcaaattgttttcgtttaatctgaatacgattgccattcataatcagccaatttgcatttttattttcctctgccaagcgtcgtagcttgttttcgccaatacgaaaatattttgacgcttcttcaatggttagggtataacgttcccaaataggaatgtcagtctgcttcataaaatcctcctttccaaatcacttatttggatttcataaaagttgttttaccagcaatcgaacagctttagcaaagctcacgggagttccacccctgcatggttctcatgtagccatactcattgcctgcgacggttttatcacgctcggactattgactgtatgggagtatcattatcacgataagaatgtcgttgcaggcaatcctgctaaagattgcttctcggatcactaacatgaatcgctcgctatctttataagataggtcatggcggttagttccgttggctcttttcttatcgaaacgtattcgattacttttattcagttttcaaagaacaatggctcgttagcctatcaaaacacattgaaagctcaatatgctttggtggaataacaaacctccctgttcgggaagcgtggaatggtttagcacgcttccacgaaaggagagaggatattacttaatttcaaatgacaaaatctttgtaatcagtctggtttccattcttccacgtaagacttcatcaacgaccatactttgattgccatattcatctttcataagtcgtagggaacgcttcgttatgtaccctctgtaatgatgtagaatctggttaatcgcttcggtatcgccatctgttgcctttacaatgagaggaaagggaatcataggatattgtgttttcattcttcaaattcctccataaactttttaattaaggctagtccactggttctatgccgatagacagtagaacggttcaatttcaacaggtctgcaatttctgaatcgctcatgtccataaagtaaaacagcagtagaatttcacgtttcttgtctggcaactcacgtaatgcttcactcaacaaatcattttcaacgcctactgataacccattgagtgtaaaaatctgaaagtcagttgaatagttatctgttgtcgcaaactggctaacaagataatcgccaacatccgaaaaggacacctcacgctttgcaatccttgaaagataaagcatataattctttcgctcgtcttccatagcacgtttacagatatagtcaaactgattttctattgtggtctgaaaagaagatggtttcatgtttctcaccccctttctgtctaggaaaggaagtgagccttgctcgtttatctcctttcactcttagtcccaatgtgaaagggggatttgttgcattactgataaataaactttgtaaaaaagttctgaatagccaaaaaagcatataaacagatttatttctctgtttacatgcttctgttattctatctatatgatttataaaaccacattggtggacgtacttatctattgcagatagacgactttttttgacaagaacccaatgtaaggaaatttattgtatatgatgtacttcatggcgacgttgacctccaacaaaccgccatttggaagtaatatacaatattttaacagcgtaaatagcactaccatataacggttttttttattggcgtttagtagtgctttttattaaatataaacctataaaccatataacacgtttttctatacctgtttttaattcagtaggaacaataaaatgtatagaggtggtctactatgcgtaaaaaagaagataaatatgattttagagcctttggtttagccattaaagaagctcgattgaaacgaggtttaactcgtgaacaagtgggagcattgattgaaattgacccacggtacttaactaatattgaaaataaagggcaacaccccagcatacaagttctttatgaccttgtatcgttacttcatgtttccgttgatgaatttttcttacctgctaataacttggtaaaaagcacccgacgattacagatagagaaatacatggatagctttacagacaaagaactatccttaatggaatctttagccagcggtatcaacgaagcaagaaacatcgaagactaattaaaagaatccatacataacggaaagagccgataaaatgagattgtattaatctcattttatcggctctgcgtctttgcgtctggctctgtaatcacagttactttgaactgctttatttcaattaaattttcttgtctgcatttcggacaatagagggggaatttttttaattcagtatcttcccttatctttaatcgtgttttatttccacatacaggacacaatatccacttgtagtttataataactatctcctcctttacactttaattcaaatctttattaaaaaatatttcatcttatttaacaagaaaccatatttatataacaacataaaatacactaagttattttattgaacatatatcgtactttatctatccgactatttggacgacggggctggcaaacaggttcaccggtagtaacatggtacccttttaactctgttaaacaaacactacgtccatttgtaaagaaagttaaatcactacgatattcttgaatacaccgagcagggatttctccactaagaatgacctcattatttttcaattgagtgtctacgatgttcgcacaatatttaggagcatcgttgtatgctcgtgaaagatattcctgtggcgcataaattttaaaactaagatatggctctaacaattctgttccagctttttttaagacttgttccaatacaataggagcaagcatccgaaaatctgctggggtactaacagggctatagtataagccatacttaaaacagattttacagtccgtcacattccaaccatacaatccttgttcacagccatagcgtatcccctccataactgcattttgaaacgattgatttaagtatccaagagaaaccgagctctcatactgtactccgctccctaatggaagctgtgctacagatagaccaatggaagcccagaaaggattcggtggaacttcgatgtgaatggtatactctgctttttttaacggtctttccatataaatgactgtaggctcttttatttctatctccacatgatacttttcttgcaacagtgcactaatcacttccatttgtactttccctaagaaagaaagtataatttcatgtgtcgtagaatccacgtaatatcgtagaagcggatcactatctgagatttccaaaagggcatcaagcaacatttctctctgttcaggtttactcggttcaacagttgtttgtagtagagggtgcggattttcaatcttttttctctgtggcaatagttttgtatctccaagaacactatttaacttcaaaaactcattttgcaaaataacaatttccccggaataagccttatcgattttacataattcaccatttattgaagtatacatttctgtaatttttattttttccttttccgatattctaaccgaatctcgcaaatgcagtacgccactataaagacgtatatatgcaagacgctgtcttttttccgaatactcaattttgaaaacttttccgcaaagttcagactgacctcgatgtgttgatgaataaaatttattcgtaatcacttctataaggttatcaatccctatattgttttttgcacttccgtgataaacagggaacagggaacaattatgaaatcttatgctttcctcttgttcgagttctaatgcttccaataatttcccagacgtatatttctctaaaaggtcatcgtttccctctattaccgtatcccattgttcagattcggtaaagttcgtcacacacatattaggatacagttctaccttctgtttgattacaatttcggcagaaagtttctctttaatatcctgataaaccgttgataaatcaattccattttggtcaatcttattgataaaaaagattgtgggaatccccattttcctaagtgcatgaaataatatacgagtttgtgcttgtacgccatcttttgcagaaatcagtagaattgccccatctaaaactgataatgaacgatatacttctgctaagaaatccatatgtcctggcgtgtctatgatgttcaccttcgtattttcccactgaaaagaggttattcctgtctgaattgtaattcctctctgacgttctaaaagcgtattatccgtcctcgttgtacctttgtccacgcttcctaattctgtaatcgctccactgttatataataagctttctgttaaggtagtttttcccgcatcaacatgagctaaaactccaatattaataattttcatgtgattttcctccattcaaaagcccaaaagggcataaaaatcccagtgataaatactcttatcactgggatttttatgcataaccataggcatacaaagcatacagatattctccggatactttagaatcacatgataaaggtattcttaaactgggtacaaaaaactaagccctcctaaaaaaggacatccaattatttgttcccactatcaaattgacagtttatttaagaataccttgccgcatatttattaactccttttaaatagatacttaaataatagcacgtaagagcatatttgtaaaggaatctccaattttttatcaaagagagtacgtgattacaaaatagctgtaataatgtaccaatatttgttattctataatcttccaattactcccgttcttttcaagtaccaaatcaaattgagatacctgcgttgctttggtctgctggtcgatatactccactgtcagcgataccgtgacttgattatccttacgattgtgaataggatttaccagttcttgaaagatgtactcttttccgattggttttaatatcccgtcattcacatagtaggaaagttcactggctgtcgctgtaggatagagcttgaagaacgtcgttaaaaactcattgatttcattggttgtaatggaatcaaccgtcccctcactttcaatggcttttggtttataacttgatttcttaggtatgttggtaatggtcggattcttaaccagtaccatatttccagaaccatctacatagacactcactatataagcagagtggacggtctttgtattttctccctctgtaatgagctggtctacactgtaggttacattaaactcattgtcgccagttggctctaccgtccatatctgaaatcctcttacagaagacgatacaggaatatctttgcgtactgtatcaacattgagagcttgaagttcatctgtcagatagccttttagactttccattcgattatcaatggacttatcggattgctcccatgaatagtagactttcgcaaagttctctacaaaattttctacatgatgagtatcaacgtattccttttctatgatagttgtttcgtgaatagtatgagtatctatagctgtaaagtgcttgaatatcgcaaagctgaaactaagccctaaaagtacccacaaggcaatcacaacctttttatgaggattgaccttatagacacgaggtttcttttcctttggtatctgtttttctttattctgattttttctaaatttcatcattaaatcttcctttctcattgtttgattcgtcctgctcccactaaatgctgttgccagtaggggcttgttaagtcggcataaccgattgggtcgcctgcatgaaacatacggttattgccaaggtatatcccaacatgagtaatataagagccagcgttataggtagaatgaaagaaaaccaaatcgccagcttgtgcttccgatagtgggatatgctgggtcacatcatattgctgttgtgcggttcgtggtaagttaattccagcttttccatacgtccattgtgtcagtccgctacaatcaaaagaagtagtcggggaagctccaccgtaaacgtatcgccagccctcatatttcagtgcttcgtccatgatggcttgtaccgtatcatcatcaaactctgttgtgacaagatactgcgttaccagttgcacataaaacatattgccatagttgtatcgccagcccccattgataggtatggctatgggattggggtaagacactttttcgccacctgaatactcttttgagaaactttgagccagttcaaaggtatatttatttccacgattagccacataccctaagaaaccaccaccataattgtaggactggataaccgattctaaatctacactgagcctttcgctactggctaataattcactgaaatacttcacaccttgcttaatggattcttctgtactcaatgaattaggtggaagaccgagggattccgaggactgcataacatcttccgcagtaccgcccgattccacctgtataatcgcaagaagtatgttgacatattcttcaacgccatattctttggcatatttttctaccataggcttatgagccagcacttctgcggaaacattcacacctccataatgaatattggaaattccgctgtcctgttcatctgaaaataaaatggcaacaaacagaagcagtgagaagaccatcaagaataatccagaaccaccaatcactaaagttttcaacttcatggtttcttaccgactttcttaatggtggcggttttgattggtggtctacttcttgtattttgtagtggtactctttgaacagtagacggacgttcttttgtgattggacgttgtgaagttctatctgctgtagtggttgaagttgctggcttttgaacggttttttcttgaacggtattgccttggcgttccacttttggacttgaaaaatcggacttaactgctggacgctcttgtttggcttgttgagattccttatatgaagtctgaatattagactgttttgaggtctgttcatcatgatattgttcttgtcttgtagtcggtctttcatgaacagaagaagcaggctgttttttctgtttgacctgttccatttcagagcgacgcttcgcaatggtttttcgcctttgttcctgctgttccttgcgtccactggctctgtccgctttggtttgagaaatactactggttaaatcacggacattctcttttactttggattttccttgatatactgcatatcttgcattggtcggcaaatctttaacctgttctttcaaaccactagcagtgtctaccattctgtctttggtatcagctactgtaccgatggtttgaccgatacgttttccaagtgttgatttttcctttccgtctggtcgggagtgatctgcttgtgtccttgcagaactccccgaacccgactgtccttttttacctgtaacaatggcagacccagcccctagagtagtcatggaacgtccaagtttccgctgtagacggtgcatgtgagcgtgcataagcatacgaggttttctcatcacacgacttcccacactttgagaatcgttactctgtagagaaaacatactcattaaatcgcccagcttgaagtagattcctgcaaaggtcacaatctgtagaaaagcaatcaaaaagaacggataaccagccgataaggtatagagcatggttgaaatactaaatgctgtcgtaataatcaatgtgattccagctcgtgtcaaaatggtattaaagagctttgttatggctcgttttgacataccatcaaatgatggaatcatgcttaaaataaagctcacaggcagaaacatagcatagatgataaaaagtacctgcgagaaaatcatgattcctgttaataggaatacaaatatggaaatcccaatattgaagacaaataggaagaagactgtacctaaacggttaatggtctttgtaatggttagattggtattgcttctgtcttcaatttcttccgcaacaattttttctctgtcttcgccattgttggaatctgggctggtggagagcaggctttccacacggtcaataccgatactttcaatgtctgaactgttgtattgaagcagtagccacggttgctgaacctgtatggaaaacaggctacctctgattaagtccacgctgtccttgccttgactatcggaatggggcatgacaatcttcgtgccaagtgataaactggcattactgatgtctgatgaaaagtcattgatttttttaatgtagtcgggagcgtaggcaataaaggaagccgataggataaacaccagcacaaaattcataatggcatgaattgcctttgtggtttctctctttatcagtcccgtataggcaacataaaccccaagaaccaaaatcaagagtaagaggaatccaacatagaaaccctctgttgaaaatccgtttgcactcacaccagctaaggtctgcatattcttaccaatggaatctgctgtagcggaaatgaagtctaaggaataggcttcctgtactaagtaacctgtcgcattggaaacatacaaactgattgtccaaataaaattggtaatggcatatagtccatacatgacctgttttccaatcccgtccgaccagttccacggaagccagccccagctattatccacataaaaatccagttgatagttttcaagtgggtatcggctgtattcatttgccacattgaccgtatcatctaccaagcccgcagcttgaaccaccgttcccagcatggctaaaagaaaaatggcaatcacaagtgtgaaagccactgtcattgccactttacctagacgtttcagcgtccagtttgattttattctgtttactattgatggtttcacatttacacctcttttcgcacaggtggtctggtatcaaaggcatggagcagttcttcaaatacagggtggaactgtatcacaccgacacgaccatataaatcactgataaggcattgcccgttttccaaatcacgcaatcgcttctgattgttttcgtcctctgggtctacaccaaaaaaggctaaggtctttttaatctcgttaaggtcagtggaacgaaatgcaaattttaagccgaggttatttttcagtttttcatctaagaggtcgtctgtattttgggtcacgaaatataccccagcgttcatagcacgaccagcccgaaccagcttcatagatagtgtttttccttgtgctacctgtaaaaagctccatgcttcgtctaaatctacaatcttgaaaatgcttcggtctgtatggataaagtctaaagcaaaggtactaatgacaatcagcatagcaacggataaaagctccatagtggtatattcctcaaaggaagtttccttgtcgggaagtaccaagtccgcaacctgtataatgttcagttgtttttctaagctgatagactgctccacataaccattactgaataataaatgtgcaaagtcatagtctgtaaaactttcgatatggtcggctatactggtacttagtggcgtattctcaacccgtaattcctcaatcactttcatcaaccctcgtacttcactattggttactgcacgaatggcttttctaaggattgggaagcgttccccatcacgagaggaaatccccgtaaggaatgtcagaatatcaatagccagtgattcagaatctttgggatttttcataatcacataagggtcaagtaagcctttgtttttctcatcagaagtcagagtgacgatattgatttcatgggaaatctctggcaaggtttctttccatctgccacgttctgcttttgggtctacaatcactgcttgtgccccataaagcaccgcataatagacgataaggttattcgcaaaggatttaccaccacccagcgaaccaacaaaagccgacgctaacgcattggttactgaacccttaaccccttgactggcaagagcaggtttcagatagacattgcgtccagtatctaagctgtagccaacataaatcccctcattttcccccagcatttgagtagcaccaaaacctaaaccagcgaggaaatcagaggtcacgtattgaatataatcattcatataacgcttgctggcaggtaaaaattcttcatgtaagccgagcatatccccaaatggtcgtaccagttttacgcttaaatcgtcataaaaatctttcacttcattacaacgacgtttgagttcgtcaagatcatttgctgatacccttaccacataagacagcttgtacatagattccttgctttggtctaaattggtttccagctcattcacactttccagagcttccgccacattggagctggtttcattatcactttgccaagcgtggttatccaagtctttcagttctttctttttattgcggacagtagatagggctttacgattcgctacaatttccacattcattgacgtatcaatcgggaatgtaaattgctgttgctggtagtagaagatttcagaggacgggaagtccagttctccgacaatgctgttaatggtaaagtaagctacatagacggtttcatcttcctgctggattttcaaatatcgctgtttttcttccaccaaacagcgagtaggcttaatcaagtcatagtatttaatcagcgtttcattatccagctttttctttgatagatggtactcatactcttcataggcagtgcctgtctgtccgtaaaggtgttcaatcagatagccgaagtcgtccttatctaacctgcggattttgaaacgacgagagattttattttctaagagcttttccatcttctgaaaacgcaggatttcatcattactcatactaacaaaatcgcccatcagcttatggttcacatcatagacaaaatcagacaaagcattttttgcttcaacggtaagacttttcatagaaaactcctgatcgttgagaagcaacttaaagccgataaagaaacggtagttcacttgattttcgccaatcatggatattaaagcgtctgtctgttggtcgattttgtcataggcaaccgctttgagcttgccagtgacttcatttttggaacgctcttgtgcagaacgtatgctggattctgtactgatttgtaaagcatgaattttgccatcacgattttgtgcgataagctgtctgaaagaatcatgcacttgtattttctgttctggacttagaaatgagtaattgtaaggaacaagctcatagtaagcataacattccccgtctttattccagacgagattgttttcaatgtatttaattggatatgccataaaattcactcctaactgctgtaatggcttcttgtggctggtttctgccaagcgttactttttttcctgcataggtcagctttggtcgcagtgcataagcaatgacagacttcaaaaatccataaggctttttaccatcaaaagtttttgtagacataaaccatgtgaaagccacaggaatcccaaagtatttgagaaatgctccctctatcatggaaagagggggcaagttgccaagtatcatcactgcaaagagtgacacgacaaaccatgtcatttgcgtaaaggttatgggaaacggaagtctaaaatcattgatagaatacagtaccttttccacagaccagatactggtatagcttcgtattttcttcatgtaatcaatcctttcataaaaaataggggtagctgattgagccaccccgtaaaatagaaaatctgccagtagtaatgtaccgacagatttaatagacgatttcaaaaatcccatgattggttgagataaacgttcctgaaaggtctaaatcccgaccataggcttgataatcaatatagttttgaagactagctggtacttcgcctaaagcacccgtttcttcaatgtagtagcgtgccacgtcatacatatcatcacaatcggaatgaatgataatatcctcttgatgttcgcttagttcttcaatgcttgaaaaatgagtgagcagagcagatagctccgattgtaattcttcgggtaattccgataccatttcccatagtcgattgagttcgccaatggaagtgtattcgtcaaccgtaaagggtaactcgtagtcatgaatggcgtattcctcatattcatcattcaagccgattttctctttgacttcctcaaagtcaatgggaaaggtaaaccacgcaccgaccaattcgccctcattgtatttgcctaaattcgcaatatagacttgcatatcgtccatatattcacgtcctttctttgtagagattcaaaaatccctaccgcacttcgtttggtgtaccattcctttgcggaacataagaaaaccacttatattccacaaaagaacggttttatttaagcaccaataatgcgattgaatagctctagtaaaatgtcttttactccagcagcgttgaagactaagccaaccgcaataatcgcaataattaaaaagccaatcagtttgctaaactcacgcttgaagccaagatacaagccaatcacaacgattgctaaaagcaccagtgattgagcgtttgatagaaaccagttataaaggttttgtccaaaattcataaaaatgttctcctctctatattcaatgaatttgtatttgagttatttttttgttgttatcacgtcctgttcttttactgactgttgcttcaaaatctgcttgtgtcggtctgtcagtttcgcatggtcgagaatgtcttttacaacctgcgtctggttgatttcatcaagtttaatcgcaacctttaaggtcggggcaacttgatgagatagccagttcagcgtcctttggaaggagtaaggctctggttttgtggttagttttaatcgttcacgattgttcccaataaaccaagcccattcttcattcagtttccaatcagaacgaggtttggaatcgtctttatctacaaaacggatataccgattgataattttaaaggcggtatgctctggattgtcatagacgagtaaatcacggactgcataataggcacgctcatttttcaatcgaatctcaaaacggttttttacttctgcgtcttcaatgggaatatcatttttcttgtactgctcgtagtccttttcatagatacagaaataaacttcactttgtaatgaaccgatatagagggtgtttcccatacattccttttcctctttgcgtaccagttcgccactgcgatagcttttaaaactgcggaagacggagatacattcttcctgttggcacttttcagtgagtacagggatatttaaaatccctgtcttatcgttaatggcaaggtcaaggcgtttcatcacaccgccagccaccaaaacgtccataaagaactcataccagcttctttgttgtgccagaagatagctttcaaattgtctgcacccacgacctttcaattccaccagaactcctttgtccagttcatgggagcaaaggacgaatatgtcgcctaaagcataatgctctgaataagaatagaaaccatagtcctcatgaagaaaataggacagtttcagttgtaagatgttttcgaccacctgctgtacgtctgttgtcggaaagcgaattcttacataatcaaacagcatttcaaggggagcgtcgggattgaagcgttccagagcttcccaaagggactgctgtaaatcctctgatggcttgacttttcctgtttcaatatcgcttagatactgccttgtaataccagtcgcaacagctaaacggttttgagatagtccataagccaagcgtttttcttttaaatgctgtaaccaagtttgttcattcagtaaaaatccctccaatcaaaaaggcgtatgtcaacttttaaagcccatttgacatacgctgaaattttgtaaatcccttgtaaccaaaggattttctaatgtttttttgactgtttcctgtcgatttgtacccccctgttagatacggggggttaagtgctggcgtggctattgccacaccagccagcaagatcagtccacacctgcgacttccgcttcgcacgtcgcctgcgtggactgtctgctgttggataactttttaatttcctccaagaaatcatatccttttggtacaaggggagtataaaactctgatatgacacttgttcctacatcaacatagccacgacctttgattcgctttaagaagaaatccttttgtacgtcactgccaaacatcatgccatagcccatttcagacatacgacctaaagccactctgaaattaaactgatcacggattccgtcgcctaaatattttgcgtctggacgttgacaagccagtattagaaagaagccagcttgacgacctaacatgacaatctgtttcagcttattcataactgcggtgttttcttttgttcccagcatttccatgaaagcgacgtattcatcaaagattaagaagtgtgccgggagacctaagtaagcataatttttgccagtcttatagttcttcatctgcttcatttcctcactacgtttcatcatttcttcatagaatgtttcaatgcaagaaagcaagtcttcttttctatagtagacatttgccatcacagaacctaagtccgcaagatcagcatttttcgggtcaagaatatacagttttgaatctgtatgaagcaaggcttcaatcagtgtcagtataaagtaagttttaccgccacctgtaccaccagcaatcaacatatgagggagcttatcatattcccaccatacgtttttcattaagcgaagtttaccatctttagcttctacttcatcaatagaaatacgactggctatggtgtcatagagcaaagtatattccacataggaatcctttaactctttatccgtcagctcacagtacaagccactctctaatttcttttccaagtgtaagagttggtcttgatattttcccagcgtgatttccacccgtatctgtatcaagccatttttaagtcgataatacattttagggaagtaggttatcttttcctttgtacgaccagcactatctttaaagaaaccctctgttttgacctgttcagattcataccacttgttttcaagtatcatctttgccagtttttgacggtggtaaagttgtttaaccgtatcatagcgaacccgtttgaatacaaacgctaccagcaagcagataagaattgcgacactgaaactgataattaaatagggaatgtcaatcttatctgcttgtgataggttaaa
